(12) United States Patent
Timms et al.

(10) Patent No.: US 11,104,956 B2
(45) Date of Patent: *Aug. 31, 2021

(54) HEREDITARY CANCER GENES

(71) Applicant: Myriad Genetics, Inc., Salt Lake City, UT (US)

(72) Inventors: Kirsten Timms, Salt Lake City, UT (US); Brian Allen, Salt Lake City, UT (US); Anne-Renee Hartman, Salt Lake City, UT (US)

(73) Assignee: Myriad Genetics, Inc., Salt Lake City, UT (US)

( * ) Notice: Subject to any disclaimer, the term of this patent is extended or adjusted under 35 U.S.C. 154(b) by 653 days.

This patent is subject to a terminal disclaimer.

(21) Appl. No.: 14/561,938

(22) Filed: Dec. 5, 2014

(65) Prior Publication Data

US 2015/0094377 A1    Apr. 2, 2015

Related U.S. Application Data

(63) Continuation of application No. PCT/US2013/044494, filed on Jun. 6, 2013.

(60) Provisional application No. 61/656,333, filed on Jun. 6, 2012, provisional application No. 61/814,068, filed on Apr. 19, 2013.

(51) Int. Cl.
| | |
|---|---|
| *C12P 19/34* | (2006.01) |
| *C12Q 1/6886* | (2018.01) |
| *G01N 33/574* | (2006.01) |
| *G16B 20/00* | (2019.01) |
| *A61K 31/138* | (2006.01) |
| *G16B 30/00* | (2019.01) |

(52) U.S. Cl.
CPC .......... *C12Q 1/6886* (2013.01); *A61K 31/138* (2013.01); *C12P 19/34* (2013.01); *G01N 33/57415* (2013.01); *G01N 33/57449* (2013.01); *G16B 20/00* (2019.02); *C12Q 2600/156* (2013.01); *C12Q 2600/16* (2013.01); *G16B 30/00* (2019.02)

(58) Field of Classification Search
USPC ....... 435/6.1, 6.11, 6.12, 91.1, 91.2; 436/94, 436/501; 536/23.1, 24.3, 24.33, 25.3
See application file for complete search history.

(56) References Cited

U.S. PATENT DOCUMENTS

| | | |
|---|---|---|
| 2003/0092019 A1 | 5/2003 | Meyer et al. |
| 2003/0096236 A1 | 5/2003 | Murphy et al. |
| 2005/0158718 A1 | 7/2005 | Taylor et al. |
| 2009/0062196 A1 | 3/2009 | D'Andrea et al. |
| 2010/0112551 A1 | 5/2010 | Dunlop et al. |
| 2011/0053157 A1 | 3/2011 | Skog et al. |
| 2012/0252904 A1 | 10/2012 | Ballotti et al. |

FOREIGN PATENT DOCUMENTS

| | | |
|---|---|---|
| WO | 2001055450 | 8/2001 |
| WO | 2005053512 | 6/2005 |
| WO | 2007148997 | 12/2007 |
| WO | 2008047128 | 4/2008 |
| WO | 2011083253 | 7/2011 |

OTHER PUBLICATIONS

Lawniczak et al., BRCA1 founder mutations do not contribute to increased risk of gastric cancer in the Polish population. Hereditary Cancer in Clinical Practice, 14, 3, 2016.*
Lindor et al., A Review of a Multifactorial Probability-Based Model for Classification of BRCA1 and BRCA2 Variants of Uncertain Significance (VUS). Human Mutation, 33, 8-21, 2012.*
Tung et al., Frequency of Germline Mutations in 25 Cancer Susceptibility Genes in a Sequential Series of Patients With Breast Cancer. Journal of Clinical Oncology, 34, 1460-1468, 2015.*
Thompson et al., Panel Testing for Familial Breast Cancer: Calibrating the Tension Between Research and Clinical Care. Journal of Clinical Oncology, 34, 1455-1459, 2015. Axilbund, Panel Testing is not a Panacea. Journal of Clinical Oncology, 34, 1433 and 1434, 2015.*
DeLeonardis et al., Challenges in Interpreting Germline Mutations in BARD1 and ATM in Breast and Ovarian Cancer Patients. The Breast Journal, 23, 461-464, 2017.*
Lynne Eldridge, Medically reviewed by a board-certified physican. Non-BRCA Gene Mutations That Raise Breast Cancer Risk: What other gene mutations are important in hereditary breast cancer? from verywellhealth.com, pp. 1-11, updated Oct. 25, 2018.*
Matyjasik et al. "DNA and RNA analyses in detection of genetic predisposition to cancer" Hereditary Cancer in Clinical Practice, vol. 6. No. 2, pp. 73-80, 2008.
McWilliams et al., "Polymorphic Variants in Hereditary Pancreatic Cancer Genes are not Associated with Pancreatic Cancer Risk," Cancer Epidemiol Biomarkers Prev 2009, 18(9), Sep. 2009, p. 2549-2552.
Meindl, Alfons et al., "Germline mutations in breast and ovarian cancer pedigrees establish RAD51C as a human cancer susceptibility gene," Nature Genetics, May 2010, 42(5):410-416.
Miller, A. et al. "Sumoylation of MITF and Its Related Family Members TFE3 and TFEB" The Journal Biological Chemistry, Jan. 7, 2005, pp. 146-155, vol. 280, No. 1.
Murakami, H. et al. "Sumoylation modulates transcriptional activity of MITF in a promoter-specific manner" Pigment Cell Research, Aug. 2005, pp. 265-277, vol. 18, No. 4.
Murphy et al., "Evaluation of Candidate Genes MAP2K4, MADH4, ACVR1B and BRCA2 in Familial Pancreatic Cancer: Deleterious BRCA2 Mutations in 17%" Cancer Research, Jul. 1, 2002, vol. 62, pp. 3789-3793.

(Continued)

*Primary Examiner* — Frank W Lu
(74) *Attorney, Agent, or Firm* — Fisherbroyles, LLP; Victoria L. Boyd; Frank W. Leak, Jr.

(57) ABSTRACT

The invention generally relates to a molecular classification of disease predisposition and particularly to molecular markers for cancer predisposition and methods of use thereof.

8 Claims, 3 Drawing Sheets
Specification includes a Sequence Listing.

(56) References Cited

OTHER PUBLICATIONS

Nihal, M. et al. "Anti-proliferative and proapoptotic effects of (−)-epigallocatechin-3-gallate on human melanoma: Possible implications for the chemoprevention of melanoma" International Journal of Cancer, Apr. 2005, pp. 513-521, vol. 114, No. 4.
Office Action issued in related Japanese Application No. 2011-526179, dated May 8, 2013.
Pooley, Karen A. et al., "Common Single-Nucleotide Polymorphisms in DNA Double-Strand Break Repair Genes and Breast Cancer Risk," Cancer Epidemiology Biomarkers & Prevention, Dec. 2008, 17(12)3482-3489.
Pylkas et al., "Analysis of large deletions in BRCA1, BRCA2 and PALB2 genes in Finnish breast and ovarian cancer families", BMC Cancer, vol. 8, No. 146, May 26, 2008.
Rahman N. et al Nature Genetics, (Feb. 2007) vol. 39, No. 2, pp. 165-167).
Reid et al., "Biallelic mutations in PALB2 cause Fanconi anemia subtype FA-N and predispose to childhood cancer," Nature Genetics, vol. 39, No. 2, Feb. 2007, pp. 162-164.
Rogers et al., "The Genetics of FANCC and FANCG in Familial Pancreatic Cancer," Cancer Biology & Therapy, 3:2, 167-169, Feb. 2004.
Samuels et al (Cancer Cell, 2005, 7(6): 561-573).
Sellick, G. et al., "Germline mutations in RAD51, RAD51AP1, RAD51B, RAD51C, RAD51D, RAD52 and RAD54L do not contribute to familial chronic lymphocytic leukemia," Leukemia and Lymphoma, Jan. 2008, 49(1): 130-133.
Sheffield et al (Am J Clin Pathol, 2002, 118(6): 930-936).
Sjoblom et al., "The Consensus Coding Sequences of Human Breast and Colorectal Cancers", Science, Oct. 13, 2006, vol. 314, No. 5797, p. 268-274.
Staaf et al. "Detection and precise mapping of germline rearrangements in BRCA1, BRCA2, MSH2, and MLH1 using zoom in array comparative genomic hybridization (aCGH)" Human Mutation, vol. 29, No. 4, pp. 555-564, 2008.
Stathopoulos et al. "Present treatment and future expectations in advanced pancreatic cancer", Anticancer Research, International Institute of Anticancer Research, GR, vol. 28, No. 2B, Mar. 1, 2008.
Thacker, J., "The RAD51 gene family, genetic instability and cancer," Cancer Letters, Mar. 10, 2005, 219(2):125-135.
The Breast Cancer Linkage Consortium (1999) Journal of the National Cancer Institute, vol. 91, No. 15, pp. 1310-1316.
Tischkowitz et al., "Analysis of PALB2/FANCN-associated breast cancer families", Proc Natl Acad Sci USA, vol. 104, No. 16, pp. 6788-6793, Apr. 2007.
Tischkowitz et al., "Analysis of the gene coding for the BRCA2-interacting protein PALB2 in hereditary prostate cancer", Prostate, vol. 68, No. 6, Feb. 20, 2008 (Epub).
Tockman et al (Cancer Res., 1992, 52: 2711s-2718s).
Vahteristo et al., "No MSH6 germline mutations in breast cancer families with colorectal and/or endometrial cancer" J Med Genet 2005: 42.
Villarroel et al. "Personalizing Cancer Treatment in the Age of Global Genomic Analyses: PALB2 Gene Mutations and the Response to DNA Damaging Agents in Pancreatic Cancer", Molecular Cancer Therapeutics, vol. 10, No. 1,Jan. 2011.
Walsh et al. "Detection of inherited mutations for breast and ovarian cancer using genomic capture and massively parallel sequencing" PNAS, vol. 107, No. 28, pp. 12629-12633, 2010.
Walsh et al. "Spectrum of mutations in BRCA1, BRCA2, CHEK2, and TP53 in families at high risk of breast cancer" The Journal of the American Medical Association, vol. 295, No. 12, pp. 1379-1388, 2006.
Wasielewski et al., "Association of rare MSH6 variants with familial breast cancer", Breast Cancer Res Treat, 2010, 123(2): 315-20.
Yokoyama, S. et al. "MITF pathway mutations in melanoma" Pigment Cell Melanoma Research, Aug. 2009, pp. 376-377, vol. 22, No. 4.
Zhang et al. "PALB2 Functionally Connects the Breast Cancer Susceptibility Proteins BRCA1 and BRCA2", Molecular Cancer Research, vol. 7, No. 7, Jul. 2009.
"Analysis of the Gene coding for the BRCA2-Interacting Protein PALB2 in Familial and Sporadic Pancreatic" Gastroenterology, Sep. 2009, vol. 137, No. 3, pp. 1183-1186.
Abbott et al. Journal of the National Cancer Institute, vol. 90, No. 13, Jul. 1, 1998, pp. 978-985.
Barlund et al., "Multiple Genes at 17q23 undergo amplification and overexpression in breast cancer," Cancer Research, Oct. 1, 2000, 60(19):5340-5344.
Caltagirone et al (Int J Cancer, 2000, 87(4): 595-600).
Cao et al., "The prevalence of PALB2 germline mutations in BRCA1/BRCA2 negative Chinese woman with early onset breast cancer or affected relatives", Breast Cancer Res Treat, vol. 114, No. 3, pp. 457-462, Apr. 30, 2008 (Epub).
Celine et al. "The Fanconi anemia pathway and ubiquitin", BMC Biochemistry, vol. 8, No. Suppl 1, 2007.
Couch et al., "Germ Line Fanconi Anemia Complementation Group C Mutations and Pancreatic Cancer," Cancer Res 2005; 65:(2), 383-386, Jan. 2005.
Cronin et al (Pigment Cell Melanoma Res, 2009, 22: 435-444).
Database EMBL [Online] Apr. 16, 2005, "S216P61126FH2.T0 Masuku Pan troglodytes troglodytes STS genomic, sequence tagged size," retrieved from EBI accession No. EM_STS:BV617345.
Database EMBL [Online] Mar. 16, 2007, "1095515635721 Global-Ocean-Sampling_GS-32-01-01-1P3-1P6KB marine metagenome genomic clone 1061005927269 3, genomic survey sequence," retrieved from EBI accession No. EM_GSS:EK524042.
Dorvault et al (Cancer, 2001, 93(5): 337-343).
Erkko et al., "A recurrent mutation in PALB2 in Finnish cancer families" (Nature vol. 446: Mar. 15, 2007).
European Communication Response, from application 10159524.7, dated May 9, 2012.
European Communication Response, from application 10159524.7, dated Dec. 12, 2013.
European Communication Response, from application 10159524.7, dated Jan. 15, 2013.
European Communication Response, from application 1171393.5, dated Feb. 12, 2013.
European Communication, from application 09812193.2, dated Sep. 5, 2014.
European Communication, from application 10159524.7, dated Oct. 8, 2012.
European Communication, from application 10159524.7, dated Oct. 8, 2013.
European Communication, from application 10749365.2, dated Aug. 20, 2013.
European Communication, from application 11713793.5, dated Oct. 8, 2013.
European Intention to Grant, from application 10159524.7, dated Feb. 7, 2014.
European Search Opinion, from application 10159524.7, dated Aug. 13, 2010.
European Supplementary Search Opinion, from Application No. 10749365.2, dated Jun. 12, 2012.
Extended European Search Report, from application 09812193.2, dated Jun. 12, 2012.
Ford, "Is breast cancer a part of Lynch syndrome?" Breast Cancer Research ,2012, 14:110.
Garcia et al. "The Fanconi anemia/BRCA pathway and cancer susceptibility. Searching for new therapeutic targets.", Clinical and Translational Oncology, vol. 10, No. 2, Feb. 1, 2008.
Godthelp, Barbara C. et al., "Mammalian Rad51C contributes to DNA cross-link resistance, sister chromatid cohesion and genomic stability," Nucleic Acids Research, May 15, 2002, 30(10): 2172-2182.
Hahn et al., "BRCA2 Germline Mutations in Familial Pancreatic Carcinoma," Journal of the National Cancer Institute, vol. 95, No. 3, Feb. 5, 2003, pp. 214-221.
Helleday T. et al. DNA Repairs 6 (2007) 923-935.
Helleday T. et al. Nature Reviews—Cancer (Mar. 2008) vol. 8, pp. 193-204.

(56) References Cited

OTHER PUBLICATIONS

Hingorani, "New Pathways to Pancreatic Cancer," Cancer Biology & Therapy, 3:2, 170-172, Feb. 2004.
Hruban et al. "Treatment of familial pancreatic cancer and its precursors", Current Treatment Options in Gastroenterology, Current Science, Philadelphia, PA, vol. 8, No. 5, Oct. 1, 2005.
International Preliminary Report for PCT/EP2011/055651, dated Oct. 18, 2012.
International Preliminary Report for PCT/US2013/044494, dated Dec. 18, 2014.
International Search Report for PCT/US2010/026290 dated Nov. 19, 2010.
International Search Report for PCT/EP2011/055651 dated Aug. 9, 2011.
International Search Report for PCT/US2013/044494 dated Sep. 13, 2013.
International Search Report from PCT/US2009/055802 dated Mar. 22, 2010.
International Written Opinion, from application PCT/FR2010/052853, dated Aug. 7, 2012.
Jimeno et al. "Molecular Biomarkers: their Increasing Role in the Diagnosis, Characterization, and Therapy Guidance in Pancreatic Cancer", Mol Cancer Ther, 5/4, pp. 787-796, Apr. 1, 2006.
Jones et al., "Core Signaling Pathways in Human Pancreatic Cancers Revealed by Global Genomic Analyses," Science, vol. 321, Sep. 26, 2008, pp. 1801-1806.
Jones et al., "Exomic Sequencing Identifies PALB2 as a Pancreatic Cancer Susceptibility Gene," Science 324 (2924), 2009.
Jonson et al., "Molecular analyses of the 15q SMAD genes in pancreatic cancer," Genes Chromosomes Cancer, Jan. 1999; 24: 62-71.
King et al (American Journal of Pathology, 1999, 155(3): 731-738).
Kuznetsov, Sergey G. et al., "Loss of Rad51c Leads to Embryonic Lethality and Modulation of Trp53-Dependent Tumorigenesis in Mice," Cancer Research, Feb. 2009, 69(3):863-872.
Li et al., "Pancreatic Cancer," The Lancet, vol. 363, Mar. 27, 2004, pp. 1049-1057.
Lord C.J. et al. Current Opinion in Pharmacology 2008, 8:363-369.
Malkin et al., "Germ Line p 53 Mutations in a Familial Syndrome of Breast Cancer, Sarcomas and Other Neoplasms", Science, Nov. 30, 1990, vol. 250, No. 4965, pp. 1233-1238.
Martin et al., "Increased prevalence of the BRCA2 polymorphic stop codon K3326X among individuals with familial pancreatic cancer," Oncogene (2005) 24, 3652-3656.
Futreal (Nature Reviews Cancer vol. 4 Mar. 2004 pp. 177-183).
Hirschhorn et al. (Genetics in Medicine. vol. 4, No. 2, pp. 45-61, Mar. 2002).
Juppner (Bone 1995 vol. 17 No. 2 Supplement 39S-42S).
Kinzler (Cell vol. 87 pp. 15-170 Oct. 18, 1996).
Ioannidis (Nature Genetics, vol. 29, pp. 306-309, Nov. 2001).
Mamanova (Nature Methods vol. 7 No. 2 Feb. 2010 pp. 111-118).
Rahman (Clinical Medicine 2014 vol. 14 No. 4 pp. 436-439).
Szabo (Cancer Biology & Therapy 3:6 pp. 515-520 Jun. 2004).
Thompson et al., (Journal of Clinical Oncology, 34, 1455-1459, 2015).
Domchek et al., Journal Clinical Oncology, 2013, vol. 31, No. 10, pp. 1267-1270.
Hartmann et al., Journal of the National Cancer Institute, 2001, vol. 93, No. 21, pp. 1633-1637.
Pennington et al., Cancer, 2013, vol. 119, pp. 332-338.
Li et al., Effectiveness of Prophylactic Surgeries in BRCA1 or BRCA2 Mutation Carriers: A Meta-analysis and Systematic Review, Clin. Cancer Res. (2016) 22:3971-3981.
Fisher et al., "Comparison of Radical Mastectomy With Alternative Treatments for Primary Breast Cancer. A First Report of Results From a Prospective Randomized Clinical Trial", Cancer, 1977, 39(6 Suppl):2827-39.
Khan et al., "Does Aggressive Local Therapy Improve Survival in Metastatic Breast Cancer?", Surgery, 2002 , 132(4):620-6; discussion 626-7.
Wanebo et al., "Risk Reduction by Contralateral Biopsy", Annals of Surgery, 1985, 201(6):667-675.

\* cited by examiner

Read1-ttctattttatttagAGCTTAACTTAGATAGCAGTAATTTC

Read2-AATTTCCCTGGAGTAAAACTGCGGTCAAAAATGTCCCTCCGTTCTTAT

Read3-TTCTTATGGAAGCCGGGAAGGATCTGTATCAA

Read4-CAAGCCGTTCTGGAGAGTGCAGTCCTGTTCCTATGGGTTCATTTCCAA

Read5-TTTCCAAGAAGAGGGTTTGTAAATGGAAGCAGAGAAAGTACT

Read6-TACTGGATATTTAGAAGAACTTGAGAAAGAGAGgtaacttttctt

Composite-
ttctattttatttagAGCTTAACTTAGATAGCAGTAATTTCCCTGGAGTAAAACTGCGGTCAAAAATGTCCCTCCGTTCTTATGGAAGCC
GGGAAGGATCTGTATCAAGCCGTTCTGGAGAGTGCAGTCCTGTTCCTATGGGTTCATTTCCAAGAAGAGGGTTTGTAAATGGAAGCAGAG
AAAGTACTGGATATTTAGAAGAACTTGAGAAAGAGAGgtaacttttctt Read1 = SEQ ID NO:717　Read5 = SEQ ID NO:721
Read2 = SEQ ID NO:718　Read6 = SEQ ID NO:722
Read3 = SEQ ID NO:719　Composite = SEQ ID NO:723
Read4 = SEQ ID NO:720

Figure 1

HEREDITARY CANCER GENES

CROSS REFERENCE TO RELATED APPLICATIONS

This application is a continuation of and claims the priority benefit of Patent Cooperation Treaty International Application Number PCT/US2013/044494 (filed Jun. 6, 2013, published as WO2013184905), which in turn claims the priority benefit of U.S. Provisional Application Ser. Nos. 61/656,333 (filed on Jun. 6, 2012) and 61/814,068 (filed on Apr. 19, 2013), each of which is hereby incorporated by reference in its entirety.

FIELD OF THE INVENTION

The invention generally relates to a molecular classification of disease predisposition and particularly to molecular markers for cancer predisposition and methods of use thereof.

SEQUENCE LISTING

The instant application was filed with a formal Sequence Listing submitted electronically as a text file. This text file, which is named "1500-01-4U-2017-10-12-SEQ-LIST-TXT-BGJ_ST25.txt", was created on Oct. 12, 2017 and is 1,760,800 bytes in size. Its contents are incorporated by reference herein in their entirety.

BACKGROUND OF THE INVENTION

Cancer is a major public health problem, accounting for roughly 25% of all deaths in the United States. *American Cancer Society*, FACTS AND FIGURES 2010. For many types of cancer, up to 10% of cases can be hereditary. Knowing that a patient has an increased risk of cancer due to hereditary factors can help such a patient to take preventive actions to reduce that risk. Thus, there is a significant need for accurate ways of determining whether a particular patient has an increased risk of cancer.

SUMMARY OF THE INVENTION

The inventors have discovered panels of genes, wherein a deficiency in any of these genes in a patient's germline confers an increased risk of specific cancers. Generally speaking, these genes may be sequenced in patients to determine predisposition to these cancers.

Accordingly, in one aspect the present invention provides a method for sequencing DNA. Generally, the method includes at least the following steps: (1) isolating from a patient sample a plurality of DNA molecules, each DNA molecule consisting of between 50 and 75,000 nucleotides in length, said plurality of DNA molecules comprising one or more exons of a plurality of genes consisting of between 10 and 200 genes, and said plurality of genes comprising APC, BRCA1, BRCA2, CDKN2A, EPCAM, MLH1, MSH2, MSH6, MUTYH, PALB2, and PMS2; and (2) determining the sequence of said plurality of DNA molecules. In some embodiments, the method further comprises comparing the sequences determined in (2) with one or more reference sequences. In some embodiments, the method further comprises correlating a difference between the sequences determined in (2) and the one or more reference sequences to a mutation in one or more of the genes in the plurality of genes. In some embodiments the plurality of DNA molecule comprises at least some certain length of intron adjacent to exon (e.g., at least 1, 2, 3, 4, 5, 6, 7, 8, 9, 10, 15, 20, 25, 30, 35, 40, 45, 50, 60, 70, 80, 90, 100 or more base pairs of the intron).

In another aspect the present invention provides a method for determining whether a patient has an increased risk of cancer, which comprises: (1) determining whether the patient has a germline deficiency in any of a plurality of genes comprising APC, BRCA1, BRCA2, CDKN2A, EPCAM, MLH1, MSH2, MSH6, MUTYH, PALB2, and PMS2; and either (2) correlating a germline deficiency in any of said plurality of genes to an increased risk (e.g., increased hereditary risk) of cancer, or (3) correlating the absence of a germline deficiency in all of said plurality of genes to no increased risk (e.g., no increased hereditary risk) of cancer (or to no identified increased risk due to the tested genes). In some embodiments, the method comprises correlating a germline deficiency in any particular gene in the plurality of genes to an increased risk of a particular cancer as shown in Table 4.

In another aspect the present invention provides a kit comprising: reagents for sequencing DNA molecules comprising one or more exons of a plurality of genes comprising APC, BRCA1, BRCA2, CDKN2A, EPCAM, MLH1, MSH2, MSH6, MUTYH, PALB2, and PMS2; and instructions for using said reagents. In some embodiments the kit comprises reagents for sequencing a plurality of genes consisting of between 11 and 200 genes, and said plurality of genes comprises APC, BRCA1, BRCA2, CDKN2A, EPCAM, MLH1, MSH2, MSH6, MUTYH, PALB2, and PMS2. In some embodiments the reagents are PCR primers specific for the plurality of genes. In some embodiments, the reagents are PCR primers specific for the exons (and optionally some certain amount of adjacent intron) of the plurality of genes.

In some embodiments of the above aspects of the invention, the plurality of genes further comprises at least 1, 2, 3, 4, 5, 6, 7, 8, or 9 genes chosen from the group consisting of ATM, BARD1, BMPR1A, CDH1, CDK4, CHEK2, TP53, PTEN, RAD51D, SMAD4, and STK11. In some embodiments the plurality of genes further comprises at least 1, 2, 3, 4, 5, 6, 7, 8, 9, 10, 11, or 12 genes chosen from the group consisting of BLM, CEBPA, FLCN, MEN1, PTCH, RET, SDH5, SDHB, SDHC, SDHD, TMEM127, and VHL. In some embodiments the plurality of genes further comprises at least 1, 2, 3, 4, 5, 6, 7, 8, 9, 10, 11, 12, 13, 14, 15, 16, 17, 18, 19, or 20 genes chosen from the group consisting of BRAF, BRIP1, FANCA, FANCB, FANCC, FANCD2, FANCE, FANCF, FANCG, FANCI, FANCL, FANCM, KRAS, MLH3, MRE11, NBS1, PIK3CA, PMS1, RAD50, and RAD51C. In some embodiments the plurality of genes further comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 genes chosen from the group consisting of APC, ATM, BARD1, BLM, BMPR1A, BRAF, BRCA1, BRCA2, BRIP1, CDH1, CDK4, CDKN2A, CEBPA, CHEK2, FANCA, FANCB, FANCC, FANCD2, FANCE, FANCF, FANCG, FANCI, FANCL, FANCM, FLCN, KRAS, MEN1, MLH1, MLH3, MRE11, MSH2, MSH6, MUTYH, NBS1, PALB2, PIK3CA, PMS1, PMS2, PTCH1, PTEN, RAD50, RAD51C, RAD51D, RET, SDHAF2, SDHB, SDHC, SDHD, SMAD4, STK11, EPCAM, TMEM127, TP53, VHL. In some embodiments the plurality of genes further comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 genes of any of Panels A-Q.

Unless otherwise defined, all technical and scientific terms used herein have the same meaning as commonly understood by one of ordinary skill in the art to which this invention pertains. Although methods and materials similar or equivalent to those described herein can be used in the practice or testing of the present invention, suitable methods and materials are described below. In case of conflict, the present specification, including definitions, will control. In addition, the materials, methods, and examples are illustrative only and not intended to be limiting.

Other features and advantages of the invention will be apparent from the following Detailed Description, and from the Claims.

BRIEF DESCRIPTION OF THE DRAWINGS

FIG. 1 illustrates how a plurality of DNA molecules can comprise a particular DNA sequence with no single molecule comprising all of such sequence.

DETAILED DESCRIPTION OF THE INVENTION

Figure 2:
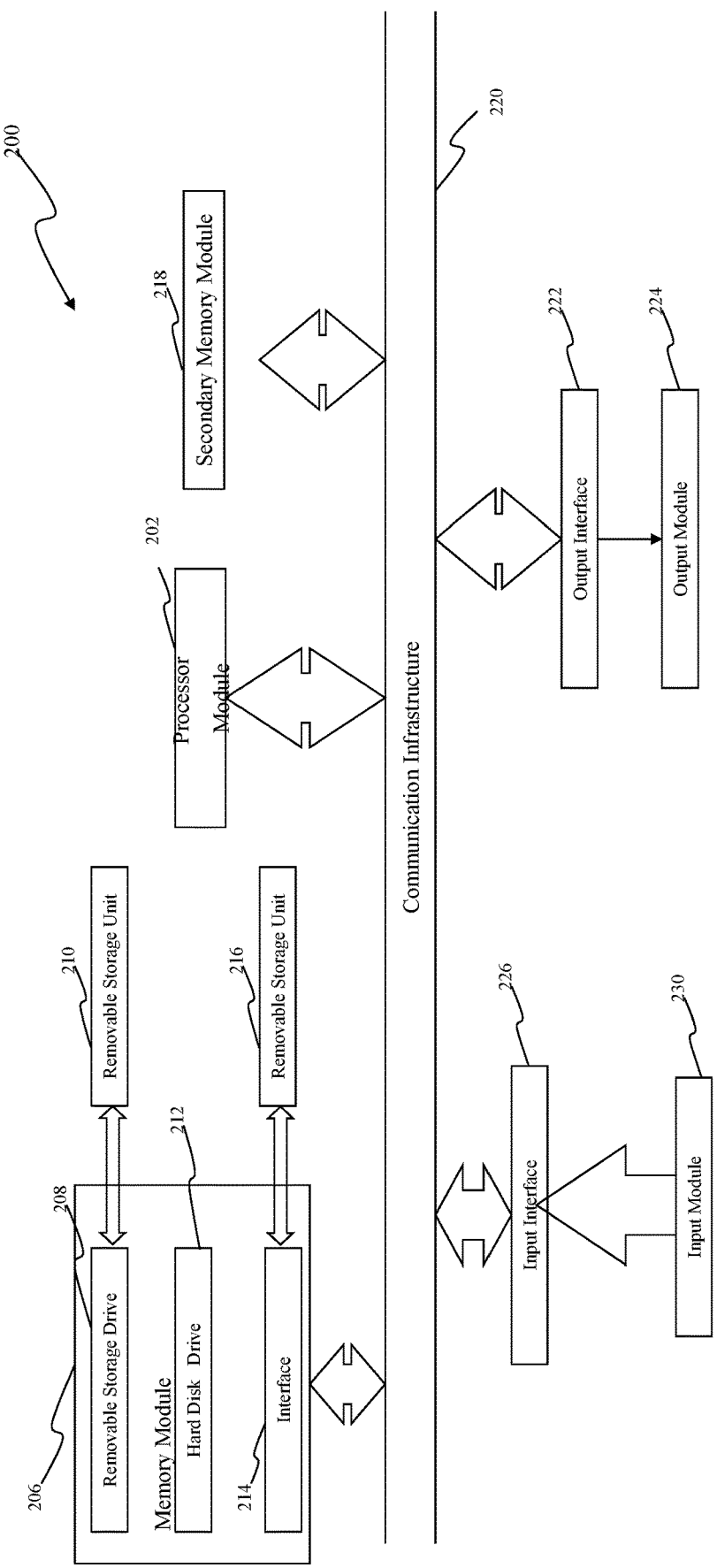
FIG. 2 is an illustration of an example of a system useful in certain aspects and embodiments of the invention.

The present invention is based in part on the discovery that hereditary cancer genes, and germline deficiencies in these genes, are responsible for increases in cancer risk attributable to heredity. "Hereditary cancer gene" and "HCG" herein refer to a gene wherein germline deficiency in the gene confers an increased risk for cancer. The inventors have discovered specific panels (e.g., pluralities) of HCGs that may be tested in a patient to give a comprehensive understanding of the patient's hereditary cancer risk. All of the HCGs in Table 1 below form a panel of HCGs ("Panel A") useful in the invention.

TABLE 1

| Gene # | Entrez Gene Symbol | Entrez Gene ID |
|---|---|---|
| 1 | APC | 324 |
| 2 | ATM | 472 |
| 3 | ATR | 545 |
| 4 | BAP1 | 8314 |
| 5 | BARD1 | 580 |
| 6 | BLM | 641 |
| 7 | BMPR1A | 657 |
| 8 | BRAF | 673 |
| 9 | BRCA1 | 672 |
| 10 | BRCA2 | 675 |
| 11 | BRIP1 | 83990 |
| 12 | CDH1 | 999 |
| 13 | CDK4 | 1019 |
| 14 | CDKN2A (p16) | 1029 |
| 15 | CEBPA | 1050 |
| 16 | CFTR | 1080 |
| 17 | CHEK2 | 11200 |
| 18 | CTRC | 11330 |
| 19 | EPCAM (TACSTD1) | 4072 |
| 20 | FANCA | 2175 |

TABLE 1-continued

| Gene # | Entrez Gene Symbol | Entrez Gene ID |
|---|---|---|
| 21 | FANCB | 2187 |
| 22 | FANCC | 2176 |
| 23 | FANCD2 | 2177 |
| 24 | FANCE | 2178 |
| 25 | FANCF | 2188 |
| 26 | FANCG | 2189 |
| 27 | FANCI | 55215 |
| 28 | FANCL | 55120 |
| 29 | FANCM | 57697 |
| 30 | FGFR2 | 2263 |
| 31 | FH | 2271 |
| 32 | FLCN | 201163 |
| 33 | HOXB13 | 10481 |
| 34 | HRAS | 3265 |
| 35 | KITLG | 4254 |
| 36 | KRAS | 3845 |
| 37 | MEN1 | 4221 |
| 38 | MLH1 | 4292 |
| 39 | MLH3 | 27030 |
| 40 | MRE11 | 4361 |
| 41 | MSH2 | 4436 |
| 42 | MSH6 | 2956 |
| 43 | MUTYH (MYH) | 4595 |
| 44 | NBS1 (NBN) | 4683 |
| 45 | NF1 | 4763 |
| 46 | NF2 | 4771 |
| 47 | PALB2 | 79728 |
| 48 | PIK3CA | 5290 |
| 49 | PMS1 | 5378 |
| 50 | PMS2 | 5395 |
| 51 | PRSS1 | 5644 |
| 52 | PTCH1 | 5727 |
| 53 | PTEN | 5728 |
| 54 | RAD50 | 10111 |
| 55 | RAD51C | 5889 |
| 56 | RAD51D | 5892 |
| 57 | RB1 | 5925 |
| 58 | RET | 5979 |
| 59 | SDHAF2 (SDH5) | 54949 |
| 60 | SDHB | 6390 |
| 61 | SDHC | 6391 |
| 62 | SDHD | 6392 |
| 63 | SMAD4 | 4089 |
| 64 | SPINK1 | 6690 |
| 65 | STK11 | 6794 |
| 66 | TGFB2 | 7042 |
| 67 | TMEM127 | 55654 |
| 68 | TP53 (p53) | 7157 |
| 69 | VHL | 7428 |

As will be shown in detail throughout this document, subsets of Panel A can also be used in the invention. Examples of subsets useful in the present invention are shown in Tables 2A to 2D below:

TABLE 2A

Panels B to G

| Gene # | Panel B | Panel C | Panel D | Panel E | Panel F | Panel G |
|---|---|---|---|---|---|---|
| 1 | BRCA1 | BRCA1 | BRCA1 | MLH1 | BRCA1 | BRCA1 |
| 2 | BRCA2 | BRCA2 | BRCA2 | MSH2 | BRCA2 | BRCA2 |
| 3 | MLH1 | MLH1 | CHEK2 | MSH6 | MLH1 | MLH1 |
| 4 | MSH2 | MSH2 | ATM | PMS2 | MSH2 | MSH2 |
| 5 | MSH6 | MSH6 | NBN | BRCA1 | MSH6 | MSH6 |
| 6 | PMS2 | PMS2 | PALB2 | BRCA2 | PMS2 | PMS2 |
| 7 | EPCAM | EPCAM | BARD1 | ATM | EPCAM | EPCAM |
| 8 | MUTYH | MUTYH | BRIP1 | BARD1 | APC | APC |
| 9 | APC | APC | PMS2 | BRIP1 | MUTYH | MUTYH |
| 10 | CDKN2A | CDKN2A | MSH2 | CHEK2 | PALB2 | PALB2 |
| 11 | PALB2 | PALB2 | MSH6 | MUTYH | CDKN2A | CHEK2 |
| 12 | SMAD4 | SMAD4 | TP53 | RAD50 | CDK4 | PTEN |
| 13 | BMPR1A | BMPR1A | MUTYH | EPCAM* | TP53 | STK11 |
| 14 | TP53 | TP53 | | | PTEN | CDH1 |
| 15 | PTEN | PTEN | | | CDH1 | TP53 |
| 16 | STK11 | STK11 | | | STK11 | ATM |
| 17 | CDH1 | CDH1 | | | SMAD4 | RAD51C |
| 18 | NBN1 | NBN1 | | | BMPR1A | RAD51D |
| 19 | CHEK2 | CHEK2 | | | ATM | BRIP1 |
| 20 | RAD51C | RAD51C | | | CHEK2 | BARD1 |
| 21 | RAD51D | RAD51D | | | RAD51C | BMPR1A |
| 22 | BRIP1 | BRIP1 | | | RAD51D | SMAD4 |
| 23 | BARD1 | BARD1 | | | MLH3 | CDKN2A |
| 24 | ATM | ATM | | | BRIP1 | CDK4 |
| 25 | CDK4 | CDK4 | | | BARD1 | RAD50 |
| 26 | | RAD50* | | | NSB1 | NBN |
| 27 | | MRE11A* | | | RAD50 | MRE11 |
| 28 | | MLH3* | | | MRE11A | MLH3 |
| 29 | | | | | HOXB13* | |

*Optional

TABLE 2B

Panels H to M

| Gene # | Panel H | Panel I | Panel J | Panel K | Panel L | Panel M |
|---|---|---|---|---|---|---|
| 1 | APC | ATM | APC | BLM | ATR | BRCA1 |
| 2 | BRCA1 | BMPR1A | ATM | CEBPA | BARD1 | BRCA2 |
| 3 | BRCA2 | CDH1 | BMPR1A | FLCN | BRAF | MLH1 |
| 4 | CDKN2A | CDK4 | BRCA1 | MEN1 | BRIP1 | MSH2 |
| 5 | EPCAM | CHEK2 | BRCA2 | PTCH | FANCA | MSH6 |
| 6 | MLH1 | HOXB13 | CDH1 | RET | FANCB | PMS2 |
| 7 | MSH2 | TP53 | CDK4 | SDHAF2 | FANCC | EPCAM |
| 8 | MSH6 | PTEN | CDKN2A | SDHB | FANCD2 | MUTYH |
| 9 | MUTYH | SMAD4 | CHEK2 | SDHC | FANCE | APC |
| 10 | PALB2 | STK11 | EPCAM | SDHD | FANCF | CDKN2A |
| 11 | PMS2 | | MLH1 | TMEM127 | FANCG | PALB2 |
| 12 | | | MSH2 | VHL | FANCI | SMAD4 |
| 13 | | | MSH6 | | FANCL | BMPR1A |
| 14 | | | MUTYH | | FANCM | TP53 |
| 15 | | | p53 | | KRAS | PTEN |
| 16 | | | PALB2 | | MLH3 | STK11 |
| 17 | | | PMS2 | | MRE11 | CDH1 |
| 18 | | | PTEN | | NBS1 | NBN1 |
| 19 | | | SMAD4 | | PIK3CA | CHEK2 |
| 20 | | | STK11 | | PMS1 | RAD51C |
| 21 | | | | | RAD50 | RAD51D |
| 22 | | | | | RAD51C | BRIP1 |
| 23 | | | | | | BARD1 |
| 24 | | | | | | ATM |
| 25 | | | | | | CDK4 |

TABLE 2C

Panel N

| Gene # | Gene Symbol |
| --- | --- |
| 1 | BRCA1 |
| 2 | BRCA2 |
| 3 | MLH1 |
| 4 | MSH2 |
| 5 | PMS2 |
| 6 | MLH3 |
| 7 | EPCAM |
| 8 | MSH6 |
| 9 | APC |
| 10 | PMS1 |
| 11 | PTEN |
| 12 | STK11 |
| 13 | RET |
| 14 | SDHD |
| 15 | SDHC |
| 16 | SDHB |
| 17 | SDHAF2 |
| 18 | CDH1 |
| 19 | MUTYH |
| 20 | SMAD4 |
| 21 | MEN1 |
| 22 | VHL |
| 23 | BMPR1A |
| 24 | PALB2 |
| 25 | TP53 |
| 26 | FANCL |
| 27 | BLM |
| 28 | CDK4 |
| 29 | CDKN2A |
| 30 | ATM |
| 31 | PTCH1 |
| 32 | CHEK2 |
| 33 | RAD51C |
| 34 | CEBPA |
| 35 | NBS1 |
| 36 | FANCA |
| 37 | FANCC |
| 38 | FANCD2 |
| 39 | FANCE |
| 40 | FANCG |
| 41 | FANCI |
| 42 | FANCM |
| 43 | RAD51D |
| 44 | FANCF |
| 45 | FANCB |
| 46 | BARD1 |
| 47 | RAD50 |
| 48 | MRE11 |
| 49 | BRIP1 |
| 50 | FLCN |
| 51 | TMEM127 |
| 52 | PIK3CA |
| 53 | KRAS |
| 54 | BRAF |
| 55 | HOXB13 |
| 56 | ATR |
| 57 | BAP1 |
| 58 | CFTR |
| 59 | CTRC |
| 60 | FGFR2 |
| 61 | FH |
| 62 | HRAS |
| 63 | KITLG |
| 64 | NF1 |
| 65 | NF2 |
| 66 | PRSS1 |
| 67 | RB1 |
| 68 | SPINK1 |
| 69 | TGFB2 |

TABLE 2D

Panel O

| Gene # | Gene Symbol |
| --- | --- |
| 1 | BRCA1 |
| 2 | BRCA2 |
| 3 | MLH1 |
| 4 | MSH2 |
| 5 | MSH6 |
| 6 | PMS2 |
| 7 | EPCAM |
| 8 | APC |
| 9 | MUTYH |
| 10 | PALB2 |
| 11 | CDKN2A |
| 12 | CDK4 |
| 13 | TP53 |
| 14 | PTEN |
| 15 | CDH1 |
| 16 | STK11 |
| 17 | SMAD4 |
| 18 | BMPR1A |
| 19 | ATM |
| 20 | CHEK2 |
| 21 | RAD51C |
| 22 | RAD51D |
| 23 | MLH3 |
| 24 | VHL |
| 25 | MEN1 |
| 26 | RET |
| 27 | NF1 |
| 28 | NF2 |
| 29 | RB1 |
| 30 | PTCH1 |
| 31 | FH |
| 32 | BLM |
| 33 | CEBPA |
| 34 | FLCN |
| 35 | SDHB |
| 36 | SDHC |
| 37 | SDHD |
| 38 | SDHAF2 |
| 39 | TMEM127 |
| 40 | CFTR |
| 41 | PRSS1 |
| 42 | CTRC |
| 43 | SPINK1 |
| 44 | KRAS |
| 45 | BRIP1 |
| 46 | BARD1 |
| 47 | NBS1 |
| 48 | RAD50 |
| 49 | FANCA |
| 50 | FANCB |
| 51 | FANCC |
| 52 | FANCD2 |
| 53 | FANCE |
| 54 | FANCF |
| 55 | FANCG |
| 56 | FANCI |
| 57 | FANCL |
| 58 | FANCM |
| 59 | ATR |
| 60 | HRAS |
| 61 | TGFB2 |
| 62 | FGFR2 |
| 63 | BAP1 |
| 64 | KITLG |
| 65 | BRAF |
| 66 | MRE11 |
| 67 | PIK3CA |
| 68 | PMS1 |
| 69 | HOXB13 |

Aspects of the Invention

Accordingly, in one aspect the present invention provides a method for sequencing nucleic acids. Generally, the method includes at least the following steps: (1) isolating a plurality of nucleic acid molecules from a sample taken from a patient, each nucleic acid molecule comprising (or consisting of or consisting essentially of) between A and B nucleotides in length, said plurality of nucleic acid molecules comprising (e.g., having nucleotide sequences that together comprise) one or more exons of a plurality of genes consisting of between W and X genes, and said plurality of genes comprising at least two genes in any of Panels A-Q; and (2) determining the sequence of said plurality of nucleic acid molecules.

In another aspect the present invention provides a method for determining whether a patient has an increased risk of cancer, which comprises: (1) determining whether the patient has a germline deficiency in any of a plurality of genes consisting of between W and X genes, said plurality of genes comprising at least two genes in any of Panels A-Q; and either (2)(a) correlating a germline deficiency in any of said plurality of genes to an increased risk (e.g., increased hereditary risk) of cancer, or (2)(b) correlating the absence of a germline deficiency in all of said plurality of genes to no increased risk (e.g., no increased hereditary risk) of cancer. In some embodiments of this aspect, the method also comprises (a) isolating a plurality of nucleic acid molecules from a sample taken from a patient, each nucleic acid molecule comprising (or consisting of or consisting essentially of) between A and B nucleotides in length, and said plurality of nucleic acid molecules comprising (e.g., having nucleotide sequences that together comprise) one or more exons of said plurality of genes and (b) determining the sequence of said plurality of nucleic acid molecules. In some embodiments, the method comprises detecting a germline deficiency in a gene by comparing the sequence determined in (b) with one or more reference sequences, as discussed in more detail below.

Thus, the invention provides a method treating a patient comprising (1) determining whether the patient has a germline deficiency in any of a plurality of genes consisting of between W and X genes, said plurality of genes comprising at least two genes in any of Panels A-Q; and (2)(a) correlating a germline deficiency in any of said plurality of genes to an increased risk (e.g., increased hereditary risk) of cancer (e.g., a particular cancer), or (2)(b) correlating the absence of a germline deficiency in all of said plurality of genes to no increased risk (e.g., no increased hereditary risk) of cancer; and (3) recommending, prescribing, or administering a treatment to reduce the patient's risk of cancer. In some embodiments, the treatment comprises removing all or part of the organ in which the patient has an increased risk of cancer (e.g., mastectomy, salpingo-oophorectomy, hysterectomy, colectomy, prostatectomy, etc.). In some embodiments the treatment comprises preventive drug treatments (e.g., tamoxifen treatment in patients with increased risk of breast or ovarian cancer).

Another aspect of the present invention provides computer program products comprising a computer-usable medium having computer-readable program codes or instructions embodied thereon for enabling a processor to carry out the methods of the invention. A related aspect of the present invention provides a system for determining whether a patient has increased likelihood of response to a particular treatment regimen. Generally speaking, the system comprises (1) computer program for receiving, storing, and/or retrieving a patient's sequence data for a plurality of genes consisting of between W and X genes, said plurality of genes comprising at least two genes in any of Panels A-Q; (2) computer program for querying this patient data; (3) optionally a computer program for comparing the patient's sequence data to one or more reference sequences to determine whether there is a mutation; (4) computer program for concluding whether there is an increased likelihood of cancer based on the presence or absence of a mutation; and optionally (4) computer program for outputting/displaying this conclusion. In some embodiments this program for outputting the conclusion may comprise a computer program for informing a health care professional of the conclusion.

In another aspect the invention provides a system for sequencing genes in a sample (e.g., tumor sample), comprising: (1) a sample analyzer for sequencing a plurality of genes consisting of between W and X genes, said plurality of genes comprising at least two genes in any of Panels A-Q, wherein the sample analyzer contains (a) the sample which is from a patient, (b) genomic DNA from the sample, (c) transcript RNA from the sample, or (d) DNA synthesized from said genomic DNA; (2) a first computer program for receiving test sequence data on the plurality of genes; and (3) a second computer program for comparing the sequence data to one or more reference sequences. In some embodiments the system comprises a computer program for determining (including quantifying) the patient's degree of risk of cancer based at least in part on the comparison of the test sequence with said one or more reference sequences. Such program may also compare the patient's determined probability of a particular cancer with a reference probability to determine whether the patient has an increased risk of such cancer.

In another aspect the invention provides methods combining the genetic analysis as described above with analysis of other cancer risk factors, e.g., a patient's family and/or personal history of cancer. In some embodiments the invention provides a method for determining a patient's risk of cancer, which comprises: (1)(a) determining whether the patient has a germline deficiency in any of a plurality of genes consisting of between W and X genes, said plurality of genes comprising at least two genes in any of Panels A-Q and (1)(b) assigning a first risk level of cancer (e.g., percentage probability of developing cancer (any cancer or a specific cancer or set of cancers) by a certain age) for the patient based on the presence or absence of such germline deficiency; (2)(a) evaluating the patient's personal and family history risk factors for cancer and (2)(b) assigning a second risk level of cancer for the patient based on the risk factors identified in (2)(a); and either (3)(a) assigning (optionally communicating and/or recording) the higher of the first and second risk levels determined in (1)(b) and (2)(b) to the patient, or (3)(b) assigning (optionally communicating and/or recording) a third risk level of cancer to the patient, wherein the third risk level is a combination of the first and second risk levels determined in (1)(b) and (2)(b). In some embodiments, the first and second risk levels are given approximately the same weight (e.g., within 5% or 10%) in assigning the third risk level. In some embodiments the ratio of the weight given to the first level to the weight given to the second risk level is approximately 1:2, 1:3, 1:4, 1:5, 1:6, 1:7, 1:8, 1:9, 1:10, 2:1, 3:1, 4:1, 5:1, 6:1, 7:1, 8:1, 9:1, 10:1, 2:3, 3:4, 4:5, 5:6, 6:7, 7:8, 8:9, 9:10, 10:11, 3:2, 4:3, 5:4, 6:5, 7:6, 8:7, 9:8, 10:9, 11:10, 3:5, 5:7, 7:9, 9:11, 11:9, 9:7, 7:5, or 5:3. In some embodiments, both the first risk level and the second risk level are communicated (e.g., to the healthcare provider, to the patient, etc.). Personal risk factors may include cancer diagnosis (including age at diagnosis), multiple primary cancers, triple negative breast cancer, ovarian cancer, smoking, age of menopause, age of menarche, positive biopsy, positive pap smear, male breast cancer, enlarged prostate, colon polyps, etc. Family risk factors can include a relative (e.g., first or second degree) with early onset (e.g., before 40, 50, or 60 years of age) cancer, particular ancestries (e.g., Ashkenazi Jewish ancestry), relative with multiple primary cancers, relative with male breast cancer, relative with ovarian cancer, relative with triple negative breast cancer, etc.

In another aspect the invention provides compositions for use in the above methods. Such compositions include, but are not limited to: (a) nucleic acid probes hybridizing to a plurality of nucleic acid molecules comprising (e.g., having nucleotide sequences that together comprise) one or more exons of a plurality of genes consisting of between W and X genes, and said plurality of genes comprising at least two genes in any of Panels A-Q; (b) nucleic acid primers and primer pairs suitable for selectively amplifying nucleic acids of (a); (c) antibodies binding immunologically to polypeptides encoded by a plurality of genes consisting of between W and X genes, and said plurality of genes comprising at least two genes in any of Panels A-Q; (d) a probe set comprising (a), (b) and/or (c); (e) a microarray comprising (a), (b), (c), and/or (d).

In another aspect the present invention provides a kit comprising: reagents for sequencing nucleic acid molecules comprising one or more exons of a plurality of genes comprising a plurality of genes consisting of between W and X genes, said plurality of genes comprising at least two genes in any of Panels A-Q; and instructions for using said reagents. In some embodiments the kit comprises (a), (b), (c), (d), and/or (e) in the preceding paragraph. In some embodiments the reagents are PCR primers specific for the plurality of genes. In some embodiments, the reagents are PCR primers specific for the exons (and optionally some certain amount of adjacent intron) of the plurality of genes (optionally also including polymerase enzyme, deoxynucleotides, buffers, etc.). In some embodiments, the reagents are oligonucleotide probes specific for the exons (and optionally some certain amount of adjacent intron) of the plurality of genes. In some embodiments the reagents (e.g., the primers and/or probes) are packaged into an array (e.g., affixed to a solid support, contained within a reaction volume, etc.).

Several aspects of the invention described herein involve a step of correlating a particular assay or analysis result or output (e.g., presence or absence of a germline deficiency in one or more genes of Panel B) to some likelihood (e.g., increased, not increased, decreased, etc.) of some clinical feature (e.g., increased risk (e.g., increased hereditary risk) of cancer). Throughout this document, wherever such an aspect is described, an alternative aspect of the invention may involve, in addition to or instead of a correlating step, one or both of the following steps: (a) concluding that the patient has or does not have the clinical feature based at least in part on the assay or analysis result; or (b) communicating that the patient has or does not have the clinical feature based at least in part on the assay or analysis result.

By way of illustration, but not limitation, one aspect described in this document is a method for determining whether a patient has an increased risk of cancer, which comprises: (1) determining whether the patient has a germline deficiency in any of a plurality of genes consisting of between W and X genes, said plurality of genes comprising at least two genes in any of Panels A-Q; and either (2)(a) correlating a germline deficiency in any of said plurality of genes to an increased risk (e.g., increased hereditary risk) of cancer, or (2)(b) correlating the absence of a germline deficiency in all of said plurality of genes to no increased risk (e.g., no increased hereditary risk) of cancer (or to no identified increased risk due to the tested genes). According to the preceding paragraph, this description of this aspect is understood to include a description of two alternative related aspects. One such embodiment provides a method for determining whether a patient has an increased risk of cancer, which comprises: (1) determining whether the patient has a germline deficiency in any of a plurality of genes consisting of between W and X genes, said plurality of genes comprising at least two test genes in any of Panels A-Q; and either (2)(a) concluding the patient an increased risk (e.g., increased hereditary risk) of cancer based at least in part on the presence of a germline deficiency in any of said plurality of genes (or in any of said test genes); or (2)(b) concluding the patient does not have an increased risk (e.g., no increased hereditary risk) of cancer based at least in part on the absence of a germline deficiency in each of said plurality of genes (or in each of said test genes) (or alternatively concluding the patient has no identified increased risk due to the tested genes). Another such embodiment provides a method for determining whether a patient has an increased risk of cancer, which comprises: (1) determining whether the patient has a germline deficiency in any of a plurality of genes consisting of between W and X genes, said plurality of genes comprising at least two test genes in any of Panels A-Q; and either (2)(a) communicating (e.g., reporting) that the patient an increased risk (e.g., increased hereditary risk) of cancer based at least in part on the presence of a germline deficiency in any of said plurality of genes (or in any of said test genes); or (2)(b) communicating (e.g., reporting) that the patient does not have an increased risk (e.g., no increased hereditary risk) of cancer based at least in part on the absence of a germline deficiency in each of said plurality of genes (or in each of said test genes) (or alternatively communicating that the patient has no identified increased risk due to the tested genes).

In each embodiment described in this document involving correlating a particular assay or analysis result or output (e.g., presence or absence of a germline deficiency in one or more genes of Panel B) to some likelihood (e.g., increased, not increased, decreased, etc.) of some clinical feature (e.g., increased risk (e.g., increased hereditary risk) of cancer), or additionally or alternatively concluding or communicating such clinical feature based at least in part on such particular assay or analysis result, such correlating, concluding or communicating may comprise assigning a risk or likelihood of the clinical feature occurring based at least in part on the particular assay or analysis result. In some embodiments, such risk is a percentage probability of the event or outcome occurring. In some embodiments, the patient is assigned to a risk group (e.g., low risk, intermediate risk, high risk, etc.). In some embodiments "low risk" is any percentage probability below 5%, 10%, 15%, 20%, 25%, 30%, 35%, 40%, 45%, or 50%. In some embodiments "intermediate risk" is any percentage probability above 5%, 10%, 15%, 20%, 25%, 30%, 35%, 40%, 45%, or 50% and below 15%, 20%, 25%, 30%, 35%, 40%, 45%, 50%, 55%, 60%, 65%, 70%, or 75%. In some embodiments "high risk" is any percentage probability above 25%, 30%, 35%, 40%, 45%, 50%, 55%, 60%, 65%, 70%, 75%, 80%, 85%, 90%, 95%, or 99%.

As used herein, "communicating" a particular piece of information means to make such information known to another person or transfer such information to a thing (e.g., a computer). In some methods of the invention, a patient's qualitative or quantitative risk of cancer (e.g., a specific cancer or syndrome listed in Table 4) is communicated. In some embodiments, the information used to arrive at such a risk prediction (e.g., presence or absence of germline deficiency in one or more genes in Panel B) is communicated.

This communication may be auditory (e.g., verbal), visual (e.g., written), electronic (e.g., data transferred from one computer system to another), etc. In some embodiments, communicating a cancer risk (e.g., "increased", "not increased", "up to X %", etc.) comprises generating a report that communicates the risk. In some embodiments the report is a paper report, an auditory report, or an electronic record. In some embodiments the report is displayed and/or stored on a computing device (e.g., handheld device, desktop computer, smart device, website, etc.). In some embodiments the cancer risk is communicated to a physician (e.g., a report communicating the risk is provided to the physician). In some embodiments the cancer risk is communicated to a patient (e.g., a report communicating the risk is provided to the patient). Communicating a cancer risk can also be accomplished by transferring information (e.g., data) embodying the risk to a server computer and allowing an intermediary or end-user to access such information (e.g., by viewing the information as displayed from the server, by downloading the information in the form of one or more files transferred from the server to the intermediary or end-user's device, etc.).

Wherever an embodiment of the invention comprises concluding some clinical feature (e.g., increased risk of cancer, etc.), this may include in some embodiments a computer program concluding such feature, typically after performing an algorithm that applies information on germline deficiency in HCGs according to the present invention.

Embodiments of these Aspects

Various embodiments of the preceding aspects of the invention are provided. Unless otherwise stated, the invention may apply each of these embodiments to each of the preceding aspects.

In some embodiments, the method or system comprises comparing the sequences determined in an earlier step or other computer program with one or more reference sequences. In some embodiments, the method comprises correlating a difference between the determined sequences and the one or more reference sequences to a mutation in one or more of the genes in the plurality of genes. In some embodiments the system comprises a computer program for determining whether the patient has a mutation in one or more of the genes in the plurality of genes by determining whether there is a difference between the determined sequences and the one or more reference sequences. In some embodiments the reference sequence for any given gene in the panel is any of the sequences corresponding to that gene as shown in Table 3 below:

TABLE 3

| SEQ ID NO | Entrez Gene Symbol | RefSeq Accession # | Transcript Variant or Exon Coordinates in SEQ ID |
|---|---|---|---|
| 1 | APC | NM_001127511.2 | trans-var-1 |
| 2 | APC | NM_001127510.2 | trans-var-2 |
| 3 | APC | NM_000038.5 | trans-var-3 |
| 4 | APC | | |
| 5 | APC | Exon 1 | 501-878 |
| 6 | APC | Exon 2 | 501-585 |
| 7 | APC | Exon 3 | 501-702 |
| 8 | APC | Exon 4 | 501-609 |
| 9 | APC | Exon 5 | 501-614 |
| 10 | APC | Exon 6 | 501-605 |
| 11 | APC | Exon 7 | 501-599 |
| 12 | APC | Exon 8 | 501-879 |

TABLE 3-continued

| SEQ ID NO | Entrez Gene Symbol | RefSeq Accession # | Transcript Variant or Exon Coordinates in SEQ ID |
|---|---|---|---|
| 13 | APC | Exon 9 | 501-596 |
| 14 | APC | Exon 10 | 501-640 |
| 15 | APC | Exon 11 | 501-578 |
| 16 | APC | Exon 12 | 501-617 |
| 17 | APC | Exon 13 | 501-715 |
| 18 | APC | Exon 14 | 501-9187 |
| 19 | APC | | |
| 20 | ATM | NM_000051.3 | |
| 21 | BARD1 | NM_000465.2 | |
| 22 | BARD1 | | |
| 23 | BARD1 | Exon 1 | 501-793 |
| 24 | BARD1 | Exon 2 | 501-557 |
| 25 | BARD1 | Exon 3 | 501-649 |
| 26 | BARD1 | Exon 4 | 501-1450 |
| 27 | BARD1 | Exon 5 | 501-581 |
| 28 | BARD1 | Exon 6 | 501-673 |
| 29 | BARD1 | Exon 7 | 501-609 |
| 30 | BARD1 | Exon 8 | 501-633 |
| 31 | BARD1 | Exon 9 | 501-593 |
| 32 | BARD1 | Exon 10 | 501-598 |
| 33 | BARD1 | Exon 11 | 501-958 |
| 34 | BARD1 | | |
| 35 | BLM | NM_000057.2 | |
| 36 | BLM | | |
| 37 | BLM | Exon 1 | 501-593 |
| 38 | BLM | Exon 2 | 501-602 |
| 39 | BLM | Exon 3 | 501-1201 |
| 40 | BLM | Exon 4 | 501-660 |
| 41 | BLM | Exon 5 | 501-628 |
| 42 | BLM | Exon 6 | 501-633 |
| 43 | BLM | Exon 7 | 501-1162 |
| 44 | BLM | Exon 8 | 501-692 |
| 45 | BLM | Exon 9 | 501-619 |
| 46 | BLM | Exon 10 | 501-614 |
| 47 | BLM | Exon 11 | 501-599 |
| 48 | BLM | Exon 12 | 501-649 |
| 49 | BLM | Exon 13 | 501-607 |
| 50 | BLM | Exon 14 | 501-661 |
| 51 | BLM | Exon 15 | 501-696 |
| 52 | BLM | Exon 16 | 501-691 |
| 53 | BLM | Exon 17 | 501-648 |
| 54 | BLM | Exon 18 | 501-700 |
| 55 | BLM | Exon 19 | 501-693 |
| 56 | BLM | Exon 20 | 501-623 |
| 57 | BLM | Exon 21 | 501-702 |
| 58 | BLM | Exon 22 | 501-855 |
| 59 | BLM | | |
| 60 | BMPR1A | NM_004329.2 | |
| 61 | BMPR1A | | |
| 62 | BMPR1A | Exon 1 | 501-781 |
| 63 | BMPR1A | Exon 2 | 501-615 |
| 64 | BMPR1A | Exon 3 | 501-719 |
| 65 | BMPR1A | Exon 4 | 501-663 |
| 66 | BMPR1A | Exon 5 | 501-603 |
| 67 | BMPR1A | Exon 6 | 501-597 |
| 68 | BMPR1A | Exon 7 | 501-600 |
| 69 | BMPR1A | Exon 8 | 501-645 |
| 70 | BMPR1A | Exon 9 | 501-693 |
| 71 | BMPR1A | Exon 10 | 501-798 |
| 72 | BMPR1A | Exon 11 | 501-676 |
| 73 | BMPR1A | Exon 12 | 501-631 |
| 74 | BMPR1A | Exon 13 | 501-2095 |
| 75 | BMPR1A | | |
| 76 | BRAF | NM_004333.4 | |
| 77 | BRAF | | |
| 78 | BRAF | Exon 1 | 501-699 |
| 79 | BRAF | Exon 2 | 501-602 |
| 80 | BRAF | Exon 3 | 501-764 |
| 81 | BRAF | Exon 4 | 501-604 |
| 82 | BRAF | Exon 5 | 501-603 |
| 83 | BRAF | Exon 6 | 501-649 |
| 84 | BRAF | Exon 7 | 501-620 |
| 85 | BRAF | Exon 8 | 501-660 |
| 86 | BRAF | Exon 9 | 501-537 |
| 87 | BRAF | Exon 10 | 501-637 |
| 88 | BRAF | Exon 11 | 501-618 |

TABLE 3-continued

| SEQ ID NO | Entrez Gene Symbol | RefSeq Accession # | Transcript Variant or Exon Coordinates in SEQ ID |
|---|---|---|---|
| 89 | BRAF | Exon 12 | 501-585 |
| 90 | BRAF | Exon 13 | 501-677 |
| 91 | BRAF | Exon 14 | 501-547 |
| 92 | BRAF | Exon 15 | 501-619 |
| 93 | BRAF | Exon 16 | 501-632 |
| 94 | BRAF | Exon 17 | 501-635 |
| 95 | BRAF | Exon 18 | 501-1258 |
| 96 | BRAF | | |
| 97 | BRCA1 | NM_007294.3 | trans-var-1 |
| 98 | BRCA1 | NM_007300.3 | trans-var-2 |
| 99 | BRCA1 | NM_007297.3 | trans-var-3 |
| 100 | BRCA1 | NM_007298.3 | trans-var-4 |
| 101 | BRCA1 | NM_007299.3 | trans-var-5 |
| 102 | BRCA1 | | |
| 103 | BRCA1 | Exon 1 | 501-713 |
| 104 | BRCA1 | Exon 2 | 501-599 |
| 105 | BRCA1 | Exon 3 | 501-554 |
| 106 | BRCA1 | Exon 4 | 501-578 |
| 107 | BRCA1 | Exon 5 | 501-589 |
| 108 | BRCA1 | Exon 6 | 501-640 |
| 109 | BRCA1 | Exon 7 | 501-606 |
| 110 | BRCA1 | Exon 8 | 501-546 |
| 111 | BRCA1 | Exon 9 | 501-577 |
| 112 | BRCA1 | Exon 10 | 501-3926 |
| 113 | BRCA1 | Exon 11 | 501-589 |
| 114 | BRCA1 | Exon 12 | 501-672 |
| 115 | BRCA1 | Exon 13 | 501-566 |
| 116 | BRCA1 | Exon 14 | 501-624 |
| 117 | BRCA1 | Exon 15 | 501-691 |
| 118 | BRCA1 | Exon 16 | 501-811 |
| 119 | BRCA1 | Exon 17 | 501-588 |
| 120 | BRCA1 | Exon 18 | 501-578 |
| 121 | BRCA1 | Exon 19 | 501-541 |
| 122 | BRCA1 | Exon 20 | 501-584 |
| 123 | BRCA1 | Exon 21 | 501-555 |
| 124 | BRCA1 | Exon 22 | 501-574 |
| 125 | BRCA1 | Exon 23 | 501-561 |
| 126 | BRCA1 | Exon 24 | 501-2008 |
| 127 | BRCA1 | | |
| 128 | BRCA2 | NM_000059.3 | |
| 129 | BRCA2 | | |
| 130 | BRCA2 | Exon 1 | 501-688 |
| 131 | BRCA2 | Exon 2 | 501-606 |
| 132 | BRCA2 | Exon 3 | 501-749 |
| 133 | BRCA2 | Exon 4 | 501-609 |
| 134 | BRCA2 | Exon 5 | 501-550 |
| 135 | BRCA2 | Exon 6 | 501-541 |
| 136 | BRCA2 | Exon 7 | 501-615 |
| 137 | BRCA2 | Exon 8 | 501-550 |
| 138 | BRCA2 | Exon 9 | 501-612 |
| 139 | BRCA2 | Exon 10 | 501-1616 |
| 140 | BRCA2 | Exon 11 | 501-5432 |
| 141 | BRCA2 | Exon 12 | 501-596 |
| 142 | BRCA2 | Exon 13 | 501-570 |
| 143 | BRCA2 | Exon 14 | 501-928 |
| 144 | BRCA2 | Exon 15 | 501-682 |
| 145 | BRCA2 | Exon 16 | 501-688 |
| 146 | BRCA2 | Exon 17 | 501-671 |
| 147 | BRCA2 | Exon 18 | 501-855 |
| 148 | BRCA2 | Exon 19 | 501-656 |
| 149 | BRCA2 | Exon 20 | 501-645 |
| 150 | BRCA2 | Exon 21 | 501-622 |
| 151 | BRCA2 | Exon 22 | 501-699 |
| 152 | BRCA2 | Exon 23 | 501-664 |
| 153 | BRCA2 | Exon 24 | 501-639 |
| 154 | BRCA2 | Exon 25 | 501-745 |
| 155 | BRCA2 | Exon 26 | 501-647 |
| 156 | BRCA2 | Exon 27 | 501-2011 |
| 157 | BRCA2 | | |
| 158 | BRIP1 | NM_032043.2 | |
| 159 | BRIP1 | NM_032043.2 | |
| 160 | BRIP1 | | |
| 161 | BRIP1 | Exon 1 | 501-776 |
| 162 | BRIP1 | Exon 2 | 501-623 |
| 163 | BRIP1 | Exon 3 | 501-612 |
| 164 | BRIP1 | Exon 4 | 501-674 |
| 165 | BRIP1 | Exon 5 | 501-628 |
| 166 | BRIP1 | Exon 6 | 501-620 |
| 167 | BRIP1 | Exon 7 | 501-791 |
| 168 | BRIP1 | Exon 8 | 501-722 |
| 169 | BRIP1 | Exon 9 | 501-700 |
| 170 | BRIP1 | Exon 10 | 501-633 |
| 171 | BRIP1 | Exon 11 | 501-655 |
| 172 | BRIP1 | Exon 12 | 501-666 |
| 173 | BRIP1 | Exon 13 | 501-641 |
| 174 | BRIP1 | Exon 14 | 501-662 |
| 175 | BRIP1 | Exon 15 | 501-660 |
| 176 | BRIP1 | Exon 16 | 501-622 |
| 177 | BRIP1 | Exon 17 | 501-613 |
| 178 | BRIP1 | Exon 18 | 501-583 |
| 179 | BRIP1 | Exon 19 | 501-830 |
| 180 | BRIP1 | Exon 20 | 501-5455 |
| 181 | BRIP1 | | |
| 182 | CDH1 | NM_004360.3 | |
| 183 | CDH1 | | |
| 184 | CDH1 | Exon 1 | 501-672 |
| 185 | CDH1 | Exon 2 | 501-615 |
| 186 | CDH1 | Exon 3 | 501-724 |
| 187 | CDH1 | Exon 4 | 501-644 |
| 188 | CDH1 | Exon 5 | 501-656 |
| 189 | CDH1 | Exon 6 | 501-645 |
| 190 | CDH1 | Exon 7 | 501-676 |
| 191 | CDH1 | Exon 8 | 501-629 |
| 192 | CDH1 | Exon 9 | 501-683 |
| 193 | CDH1 | Exon 10 | 501-745 |
| 194 | CDH1 | Exon 11 | 501-646 |
| 195 | CDH1 | Exon 12 | 501-725 |
| 196 | CDH1 | Exon 13 | 501-728 |
| 197 | CDH1 | Exon 14 | 501-631 |
| 198 | CDH1 | Exon 15 | 501-644 |
| 199 | CDH1 | Exon 16 | 501-2752 |
| 200 | CDH1 | | |
| 201 | CDK4 | NM_000075.3 | |
| 202 | CDK4 | | |
| 203 | CDK4 | Exon 1 | 501-773 |
| 204 | CDK4 | Exon 2 | 501-737 |
| 205 | CDK4 | Exon 3 | 501-636 |
| 206 | CDK4 | Exon 4 | 501-668 |
| 207 | CDK4 | Exon 5 | 501-610 |
| 208 | CDK4 | Exon 6 | 501-551 |
| 209 | CDK4 | Exon 7 | 501-636 |
| 210 | CDK4 | Exon 8 | 501-1391 |
| 211 | CDK4 | | |
| 212 | CDKN2A | NM_000077.4 | trans-var-1 |
| 213 | CDKN2A | NM_058197.4 | trans-var-3 |
| 214 | CDKN2A | NM_058195.3 | trans-var-4 |
| 215 | CDKN2A | NM_001195132.1 | trans-var-5 |
| 216 | CDKN2A | | |
| 217 | CDKN2A | Exon 1 | 501-956 |
| 218 | CDKN2A | Exon 2 | 501-807 |
| 219 | CDKN2A | Exon 3 | 501-697 |
| 220 | CDKN2A | Exon 4 | 501-991 |
| 221 | CDKN2A | | |
| 222 | CEBPA | NM_004364.3 | |
| 223 | CHEK2 | NM_007194.3 | trans-var-1 |
| 224 | CHEK2 | NM_145862.2 | trans-var-2 |
| 225 | CHEK2 | NM_001005735.1 | trans-var-3 |
| 226 | CHEK2 | | |
| 227 | CHEK2 | Exon 1 | 501-566 |
| 228 | CHEK2 | Exon 2 | 501-825 |
| 229 | CHEK2 | Exon 3 | 501-629 |
| 230 | CHEK2 | Exon 4 | 501-625 |
| 231 | CHEK2 | Exon 5 | 501-648 |
| 232 | CHEK2 | Exon 6 | 501-591 |
| 233 | CHEK2 | Exon 7 | 501-609 |
| 234 | CHEK2 | Exon 8 | 501-554 |
| 235 | CHEK2 | Exon 9 | 501-562 |
| 236 | CHEK2 | Exon 10 | 501-600 |
| 237 | CHEK2 | Exon 11 | 501-587 |
| 238 | CHEK2 | Exon 12 | 501-664 |
| 239 | CHEK2 | Exon 13 | 501-616 |
| 240 | CHEK2 | Exon 14 | 501-586 |

TABLE 3-continued

| SEQ ID NO | Entrez Gene Symbol | RefSeq Accession # | Transcript Variant or Exon Coordinates in SEQ ID |
|---|---|---|---|
| 241 | CHEK2 | Exon 15 | 501-581 |
| 242 | CHEK2 | Exon 16 | 501-744 |
| 243 | CHEK2 | | |
| 244 | EPCAM | NM_002354.2 | |
| 245 | EPCAM | | |
| 246 | EPCAM | Exon 1 | 501-934 |
| 247 | EPCAM | Exon 2 | 501-608 |
| 248 | EPCAM | Exon 3 | 501-741 |
| 249 | EPCAM | Exon 4 | 501-566 |
| 250 | EPCAM | Exon 5 | 501-564 |
| 251 | EPCAM | Exon 6 | 501-602 |
| 252 | EPCAM | Exon 7 | 501-701 |
| 253 | EPCAM | Exon 8 | 501-545 |
| 254 | EPCAM | Exon 9 | 501-957 |
| 255 | EPCAM | | |
| 256 | FANCA | NM_000135.2 | trans-var-1 |
| 257 | FANCA | NM_001018112.1 | trans-var-2 |
| 258 | FANCB | NM_001018113.1 | trans-var-1 |
| 259 | FANCB | NM_152633.2 | trans-var-2 |
| 260 | FANCC | NM_000136.2 | trans-var-1 |
| 261 | FANCC | NM_001243743.1 | trans-var-2 |
| 262 | FANCC | NM_001243744.1 | trans-var-3 |
| 263 | FANCD2 | NM_033084.3 | trans-var-1 |
| 264 | FANCD2 | NM_001018115.1 | trans-var-2 |
| 265 | FANCE | NM_021922.2 | |
| 266 | FANCF | NM_022725.3 | |
| 267 | FANCG | NM_004629.1 | |
| 268 | FANCI | NM_001113378.1 | trans-var-1 |
| 269 | FANCI | NM_018193.2 | trans-var-2 |
| 270 | FANCL | NM_001114636.1 | trans-var-1 |
| 271 | FANCL | NM_018062.3 | trans-var-2 |
| 272 | FANCM | NM_020937.2 | |
| 273 | FLCN | NM_144997.5 | trans-var-1 |
| 274 | FLCN | NM_144606.5 | trans-var-2 |
| 275 | HOXB13 | NM_006361.5 | |
| 276 | HOXB13 | | |
| 277 | HOXB13 | Exon 1 | 501-1257 |
| 278 | HOXB13 | Exon 2 | 501-2779 |
| 279 | HOXB13 | | |
| 280 | KRAS | NM_033360.2 | trans-var-a |
| 281 | KRAS | NM_004985.3 | trans-var-b |
| 282 | MEN1 | NM_000244.3 | trans-var-1 |
| 283 | MEN1 | NM_130799.2 | trans-var-2 |
| 284 | MEN1 | NM_130800.2 | trans-var-e1B |
| 285 | MEN1 | NM_130801.2 | trans-var-e1C |
| 286 | MEN1 | NM_130802.2 | trans-var-e1D |
| 287 | MEN1 | NM_130803.2 | trans-var-e1E |
| 288 | MEN1 | NM_130804.2 | trans-var-e1F1 |
| 289 | MLH1 | NM_000249.3 | trans-var-1 |
| 290 | MLH1 | NM_001167617.1 | trans-var-2 |
| 291 | MLH1 | NM_001167618.1 | trans-var-3 |
| 292 | MLH1 | NM_001167619.1 | trans-var-4 |
| 293 | MLH1 | | |
| 294 | MLH1 | Exon 1 | 501-814 |
| 295 | MLH1 | Exon 2 | 501-591 |
| 296 | MLH1 | Exon 3 | 501-599 |
| 297 | MLH1 | Exon 4 | 501-574 |
| 298 | MLH1 | Exon 5 | 501-573 |
| 299 | MLH1 | Exon 6 | 501-592 |
| 300 | MLH1 | Exon 7 | 501-543 |
| 301 | MLH1 | Exon 8 | 501-589 |
| 302 | MLH1 | Exon 9 | 501-613 |
| 303 | MLH1 | Exon 10 | 501-594 |
| 304 | MLH1 | Exon 11 | 501-654 |
| 305 | MLH1 | Exon 12 | 501-871 |
| 306 | MLH1 | Exon 13 | 501-649 |
| 307 | MLH1 | Exon 14 | 501-609 |
| 308 | MLH1 | Exon 15 | 501-564 |
| 309 | MLH1 | Exon 16 | 501-665 |
| 310 | MLH1 | Exon 17 | 501-593 |
| 311 | MLH1 | Exon 18 | 501-614 |
| 312 | MLH1 | Exon 19 | 501-861 |
| 313 | MLH1 | | |
| 314 | MLH3 | NM_001040108.1 | trans-var-1 |
| 315 | MLH3 | NM_014381.2 | trans-var-2 |
| 316 | MLH3 | | |
| 317 | MLH3 | Exon 1 | 501-653 |
| 318 | MLH3 | Exon 2 | 501-3843 |
| 319 | MLH3 | Exon 3 | 501-599 |
| 320 | MLH3 | Exon 4 | 501-586 |
| 321 | MLH3 | Exon 5 | 501-605 |
| 322 | MLH3 | Exon 6 | 501-573 |
| 323 | MLH3 | Exon 7 | 501-572 |
| 324 | MLH3 | Exon 8 | 501-612 |
| 325 | MLH3 | Exon 9 | 501-660 |
| 326 | MLH3 | Exon 10 | 501-524 |
| 327 | MLH3 | Exon 11 | 501-579 |
| 328 | MLH3 | Exon 12 | 501-652 |
| 329 | MLH3 | Exon 13 | 501-3938 |
| 330 | MLH3 | | |
| 331 | MRE11A | NM_005591.3 | trans-var-1 |
| 332 | MRE11A | NM_005590.3 | trans-var-2 |
| 333 | MRE11A | | |
| 334 | MRE11A | Exon 1 | 501-584 |
| 335 | MRE11A | Exon 2 | 501-625 |
| 336 | MRE11A | Exon 3 | 501-633 |
| 337 | MRE11A | Exon 4 | 501-661 |
| 338 | MRE11A | Exon 5 | 501-588 |
| 339 | MRE11A | Exon 6 | 501-642 |
| 340 | MRE11A | Exon 7 | 501-615 |
| 341 | MRE11A | Exon 8 | 501-686 |
| 342 | MRE11A | Exon 9 | 501-672 |
| 343 | MRE11A | Exon 10 | 501-581 |
| 344 | MRE11A | Exon 11 | 501-627 |
| 345 | MRE11A | Exon 12 | 501-601 |
| 346 | MRE11A | Exon 13 | 501-674 |
| 347 | MRE11A | Exon 14 | 501-563 |
| 348 | MRE11A | Exon 15 | 501-720 |
| 349 | MRE11A | Exon 16 | 501-584 |
| 350 | MRE11A | Exon 17 | 501-559 |
| 351 | MRE11A | Exon 18 | 501-568 |
| 352 | MRE11A | Exon 19 | 501-576 |
| 353 | MRE11A | Exon 20 | 501-3379 |
| 354 | MRE11A | | |
| 355 | MSH2 | NM_000251.1 | |
| 356 | MSH2 | | |
| 357 | MSH2 | Exon 1 | 501-779 |
| 358 | MSH2 | Exon 2 | 501-655 |
| 359 | MSH2 | Exon 3 | 501-779 |
| 360 | MSH2 | Exon 4 | 501-647 |
| 361 | MSH2 | Exon 5 | 501-650 |
| 362 | MSH2 | Exon 6 | 501-634 |
| 363 | MSH2 | Exon 7 | 501-700 |
| 364 | MSH2 | Exon 8 | 501-610 |
| 365 | MSH2 | Exon 9 | 501-624 |
| 366 | MSH2 | Exon 10 | 501-651 |
| 367 | MSH2 | Exon 11 | 501-598 |
| 368 | MSH2 | Exon 12 | 501-746 |
| 369 | MSH2 | Exon 13 | 501-705 |
| 370 | MSH2 | Exon 14 | 501-748 |
| 371 | MSH2 | Exon 15 | 501-676 |
| 372 | MSH2 | Exon 16 | 501-943 |
| 373 | MSH2 | | |
| 374 | MSH6 | NM_000179.2 | |
| 375 | MSH6 | | |
| 376 | MSH6 | Exon 1 | 501-912 |
| 377 | MSH6 | Exon 2 | 501-697 |
| 378 | MSH6 | Exon 3 | 501-670 |
| 379 | MSH6 | Exon 4 | 501-3045 |
| 380 | MSH6 | Exon 5 | 501-766 |
| 381 | MSH6 | Exon 6 | 501-618 |
| 382 | MSH6 | Exon 7 | 501-590 |
| 383 | MSH6 | Exon 8 | 501-654 |
| 384 | MSH6 | Exon 9 | 501-700 |
| 385 | MSH6 | Exon 10 | 501-675 |
| 386 | MSH6 | | |
| 387 | MUTYH | NM_012222.2 | trans-var-alpha1 |
| 388 | MUTYH | NM_001048171.1 | trans-var-alpha3 |
| 389 | MUTYH | NM_001128425.1 | trans-var-alpha5 |

TABLE 3-continued

| SEQ ID NO | Entrez Gene Symbol | RefSeq Accession # | Transcript Variant or Exon Coordinates in SEQ ID |
|---|---|---|---|
| 390 | MUTYH | NM_001048174.1 | trans-var-beta3 |
| 391 | MUTYH | NM_001048172.1 | trans-var-gamma2 |
| 392 | MUTYH | NM_001048173.1 | trans-var-gamma3 |
| 393 | MUTHY | | |
| 394 | MUTHY | Exon 1 | 501-752 |
| 395 | MUTHY | Exon 2 | 501-621 |
| 396 | MUTHY | Exon 3 | 501-691 |
| 397 | MUTHY | Exon 4 | 501-540 |
| 398 | MUTHY | Exon 5 | 501-574 |
| 399 | MUTHY | Exon 6 | 501-542 |
| 400 | MUTHY | Exon 7 | 501-572 |
| 401 | MUTHY | Exon 8 | 501-614 |
| 402 | MUTHY | Exon 9 | 501-598 |
| 403 | MUTHY | Exon 10 | 501-645 |
| 404 | MUTHY | Exon 11 | 501-564 |
| 405 | MUTHY | Exon 12 | 501-689 |
| 406 | MUTHY | Exon 13 | 501-637 |
| 407 | MUTHY | Exon 14 | 501-653 |
| 408 | MUTHY | Exon 15 | 501-542 |
| 409 | MUTHY | Exon 16 | 501-696 |
| 410 | MUTHY | | |
| 411 | NBN | NM_002485.4 | |
| 412 | NBN | | |
| 413 | NBN | Exon 1 | 501-647 |
| 414 | NBN | Exon 2 | 501-634 |
| 415 | NBN | Exon 3 | 501-649 |
| 416 | NBN | Exon 4 | 501-660 |
| 417 | NBN | Exon 5 | 501-604 |
| 418 | NBN | Exon 6 | 501-618 |
| 419 | NBN | Exon 7 | 501-694 |
| 420 | NBN | Exon 8 | 501-598 |
| 421 | NBN | Exon 9 | 501-630 |
| 422 | NBN | Exon 10 | 501-773 |
| 423 | NBN | Exon 11 | 501-948 |
| 424 | NBN | Exon 12 | 501-569 |
| 425 | NBN | Exon 13 | 501-656 |
| 426 | NBN | Exon 14 | 501-614 |
| 427 | NBN | Exon 15 | 501-550 |
| 428 | NBN | Exon 16 | 501-2777 |
| 429 | NBN | | |
| 430 | PALB2 | NM_024675.3 | |
| 431 | PALB2 | | |
| 432 | PALB2 | Exon 1 | 501-748 |
| 433 | PALB2 | Exon 2 | 501-560 |
| 434 | PALB2 | Exon 3 | 501-603 |
| 435 | PALB2 | Exon 4 | 501-1973 |
| 436 | PALB2 | Exon 5 | 501-1330 |
| 437 | PALB2 | Exon 6 | 501-572 |
| 438 | PALB2 | Exon 7 | 501-662 |
| 439 | PALB2 | Exon 8 | 501-586 |
| 440 | PALB2 | Exon 9 | 501-662 |
| 441 | PALB2 | Exon 10 | 501-617 |
| 442 | PALB2 | Exon 11 | 501-588 |
| 443 | PALB2 | Exon 12 | 501-649 |
| 444 | PALB2 | Exon 13 | 501-1008 |
| 445 | PALB2 | | |
| 446 | PIK3CA | NM_006218.2 | |
| 447 | PMS1 | NM_000534.4 | trans-var-1 |
| 448 | PMS1 | NM_001128143.1 | trans-var-2 |
| 449 | PMS1 | NM_001128144.1 | trans-var-3 |
| 450 | PMS2 | NM_000535.5 | |
| 451 | PMS2 | | |
| 452 | PMS2 | Exon 1 | 501-610 |
| 453 | PMS2 | Exon 2 | 501-640 |
| 454 | PMS2 | Exon 3 | 501-587 |
| 455 | PMS2 | Exon 4 | 501-603 |
| 456 | PMS2 | Exon 5 | 501-684 |
| 457 | PMS2 | Exon 6 | 501-668 |
| 458 | PMS2 | Exon 7 | 501-598 |
| 459 | PMS2 | Exon 8 | 501-600 |
| 460 | PMS2 | Exon 9 | 501-585 |
| 461 | PMS2 | Exon 10 | 501-656 |
| 462 | PMS2 | Exon 11 | 501-1362 |
| 463 | PMS2 | Exon 12 | 501-668 |
| 464 | PMS2 | Exon 13 | 501-601 |
| 465 | PMS2 | Exon 14 | 501-670 |
| 466 | PMS2 | Exon 15 | 501-804 |
| 467 | PMS2 | | |
| 468 | PTCH1 | NM_001083602.1 | trans-var-1a |
| 469 | PTCH1 | NM_001083603.1 | trans-var-1a' |
| 470 | PTCH1 | NM_000264.3 | trans-var-1b |
| 471 | PTCH1 | NM_001083604.1 | trans-var-1c |
| 472 | PTCH1 | NM_001083605.1 | trans-var-1c' |
| 473 | PTCH1 | NM_001083606.1 | trans-var-1d |
| 474 | PTCH1 | NM_001083607.1 | trans-var-1e |
| 475 | PTEN | NM_000314.4 | |
| 476 | PTEN | | |
| 477 | PTEN | Exon 1 | 501-1611 |
| 478 | PTEN | Exon 2 | 501-585 |
| 479 | PTEN | Exon 3 | 501-545 |
| 480 | PTEN | Exon 4 | 501-544 |
| 481 | PTEN | Exon 5 | 501-739 |
| 482 | PTEN | Exon 6 | 501-642 |
| 483 | PTEN | Exon 7 | 501-667 |
| 484 | PTEN | Exon 8 | 501-725 |
| 485 | PTEN | Exon 9 | 501-3989 |
| 486 | PTEN | | |
| 487 | RAD50 | NM_005732.3 | |
| 488 | RAD50 | | |
| 489 | RAD50 | Exon 1 | 501-1030 |
| 490 | RAD50 | Exon 2 | 501-584 |
| 491 | RAD50 | Exon 3 | 501-651 |
| 492 | RAD50 | Exon 4 | 501-686 |
| 493 | RAD50 | Exon 5 | 501-705 |
| 494 | RAD50 | Exon 6 | 501-629 |
| 495 | RAD50 | Exon 7 | 501-666 |
| 496 | RAD50 | Exon 8 | 501-694 |
| 497 | RAD50 | Exon 9 | 501-707 |
| 498 | RAD50 | Exon 10 | 501-683 |
| 499 | RAD50 | Exon 11 | 501-685 |
| 500 | RAD50 | Exon 12 | 501-676 |
| 501 | RAD50 | Exon 13 | 501-738 |
| 502 | RAD50 | Exon 14 | 501-690 |
| 503 | RAD50 | Exon 15 | 501-627 |
| 504 | RAD50 | Exon 16 | 501-694 |
| 505 | RAD50 | Exon 17 | 501-611 |
| 506 | RAD50 | Exon 18 | 501-593 |
| 507 | RAD50 | Exon 19 | 501-614 |
| 508 | RAD50 | Exon 20 | 501-628 |
| 509 | RAD50 | Exon 21 | 501-725 |
| 510 | RAD50 | Exon 22 | 501-586 |
| 511 | RAD50 | Exon 23 | 501-643 |
| 512 | RAD50 | Exon 24 | 501-634 |
| 513 | RAD50 | Exon 25 | 501-2944 |
| 514 | RAD50 | | |
| 515 | RAD51C | NM_058216.1 | trans-var-1 |
| 516 | RAD51C | NM_002876.2 | trans-var-2 |
| 517 | RAD51C | | |
| 518 | RAD51C | Exon 1 | 501-687 |
| 519 | RAD51C | Exon 2 | 501-904 |
| 520 | RAD51C | | |
| 521 | RAD51D | NM_002878.3 | trans-var-1 |
| 522 | RAD51D | NM_133629.2 | trans-var-4 |
| 523 | RAD51D | NM_001142571.1 | trans-var-6 |
| 524 | RAD51D | | |
| 525 | RAD51D | Exon 1 | 501-838 |
| 526 | RAD51D | Exon 2 | 501-562 |
| 527 | RAD51D | Exon 3 | 501-679 |
| 528 | RAD51D | Exon 4 | 501-619 |
| 529 | RAD51D | Exon 5 | 501-582 |
| 530 | RAD51D | Exon 6 | 501-635 |
| 531 | RAD51D | Exon 7 | 501-596 |
| 532 | RAD51D | Exon 8 | 501-591 |
| 533 | RAD51D | Exon 9 | 501-571 |
| 534 | RAD51D | Exon 10 | 501-665 |
| 535 | RAD51D | Exon 11 | 501-1745 |
| 536 | RAD51D | | |
| 537 | RET | NM_020975.4 | trans-var-2 |
| 538 | RET | NM_020630.4 | trans-var-4 |

TABLE 3-continued

| SEQ ID NO | Entrez Gene Symbol | RefSeq Accession # | Transcript Variant or Exon Coordinates in SEQ ID |
|---|---|---|---|
| 539 | SDHAF2 | NM_017841.2 | |
| 540 | SDHB | NM_003000.2 | |
| 541 | SDHC | NM_003001.3 | trans-var-1 |
| 542 | SDHC | NM_001035511.1 | trans-var-2 |
| 543 | SDHC | NM_001035512.1 | trans-var-3 |
| 544 | SDHC | NM_001035513.1 | trans-var-4 |
| 545 | SDHD | NM_003002.2 | |
| 546 | SMAD4 | NM_005359.5 | |
| 547 | SMAD4 | | |
| 548 | SMAD4 | Exon 1 | 501-911 |
| 549 | SMAD4 | Exon 2 | 501-876 |
| 550 | SMAD4 | Exon 3 | 501-675 |
| 551 | SMAD4 | Exon 4 | 501-530 |
| 552 | SMAD4 | Exon 5 | 501-713 |
| 553 | SMAD4 | Exon 6 | 501-620 |
| 554 | SMAD4 | Exon 7 | 501-617 |
| 555 | SMAD4 | Exon 8 | 501-551 |
| 556 | SMAD4 | Exon 9 | 501-684 |
| 557 | SMAD4 | Exon 10 | 501-669 |
| 558 | SMAD4 | Exon 11 | 501-639 |
| 559 | SMAD4 | Exon 12 | 501-7286 |
| 560 | SMAD4 | | |
| 561 | STK11 | NM_000455.4 | |
| 562 | STK11 | | |
| 563 | STK11 | Exon 1 | 501-1905 |
| 564 | STK11 | Exon 2 | 501-584 |
| 565 | STK11 | Exon 3 | 501-590 |
| 566 | STK11 | Exon 4 | 501-633 |
| 567 | STK11 | Exon 5 | 501-637 |
| 568 | STK11 | Exon 6 | 501-628 |
| 569 | STK11 | Exon 7 | 501-558 |
| 570 | STK11 | Exon 8 | 501-688 |
| 571 | STK11 | Exon 9 | 501-710 |
| 572 | STK11 | Exon 10 | 501-1343 |
| 573 | STK11 | | |
| 574 | TMEM127 | NM_017849.3 | trans-var-1 |
| 575 | TMEM127 | NM_001193304.2 | trans-var-2 |
| 576 | TP53 | NM_000546.4 | trans-var-1 |
| 577 | TP53 | NM_001126112.2 | trans-var-2 |
| 578 | TP53 | NM_001126114.1 | trans-var-3 |
| 579 | TP53 | NM_001126113.1 | trans-var-4 |
| 580 | TP53 | NM_001126115.1 | trans-var-5 |
| 581 | TP53 | NM_001126116.1 | trans-var-6 |
| 582 | TP53 | NM_001126117.1 | trans-var-7 |
| 583 | TP53 | | |
| 584 | TP53 | | |
| 585 | TP53 | Exon 1 | 501-674 |
| 586 | TP53 | Exon 2 | 501-602 |
| 587 | TP53 | Exon 3 | 501-741 |
| 588 | TP53 | Exon 4 | 501-522 |
| 589 | TP53 | Exon 5 | 501-779 |
| 590 | TP53 | Exon 6 | 501-684 |
| 591 | TP53 | Exon 7 | 501-613 |
| 592 | TP53 | Exon 8 | 501-941 |
| 593 | TP53 | Exon 9 | 501-610 |
| 594 | TP53 | Exon 10 | 501-637 |
| 595 | TP53 | Exon 11 | 501-574 |
| 596 | TP53 | Exon 12 | 501-607 |
| 597 | TP53 | Exon 13 | 501-560 |
| 598 | TP53 | Exon 14 | 501-633 |
| 599 | TP53 | Exon 15 | 501-1789 |
| 600 | TP53 | | |
| 601 | VHL | NM_000551.3 | trans-var-1 |
| 602 | VHL | NM_198156.2 | trans-var-2 |

Table 3 shows how sequence identifiers (i.e., SEQ ID NOs) correspond to different reference sequences useful for the various HCGs in various aspects of the invention. As used in Table 3, "transcript variant" refers to differently spliced transcripts expressed from some genes. In cases where no transcript variant is indicated, this is because NCBI lists only one transcript for the relevant gene. The exon coordinates given in Table 3 indicate where in each relevant sequence the exons are found. The first 500 and last 500 nucleotides of each such sequence are intronic. As used herein, "exon/intron boundary" in one of these sequences means a certain number of nucleotides (e.g., 1, 2, 3, 4, 5, 10, 15, 20, 30, 40, 50, 75, 100 or more) on each side of the transition (e.g., phosphodiester bond) from exon to intron (or from intron to exon) or a portion of the nucleotide sequence of at least a certain length (e.g., 1, 2, 3, 4, 5, 10, 15, 20, 30, 40, 50, 75, 100 or more) comprising the two nucleotides on each side of the transition from exon to intron (or from intron to exon).

In some embodiments of various aspects of the invention, a nucleic acid of the invention (e.g., in a primer set, in an array, in a kit, etc.) comprises at least 5, 6, 7, 8, 9, 10, 11, 12, 13, 14, 15, 16, 17, 18, 19, 20, 25, 30, 35, 40, 45, 50, 60, 70, 80, 90, or 100 or more nucleotides on each side of such transition. Thus, an oligonucleotide (e.g., primer) according to the invention targeting Exon 3 of the APC gene "comprising 10 nucleotides on each side of the 5' exon/intron boundary of Exon 3 of the APC gene" would comprise nucleotides 491-510 of SEQ ID NO:7, or the following sequence: 5'-ttttatttagAGCTTAACTT-3' (SEQ ID NO:724; with lower case letters indicating intronic sequence and capitalized letters indicating exonic sequence). In some embodiments of various aspects of the invention, a nucleic acid of the invention comprises at least 5, 6, 7, 8, 9, 10, 11, 12, 13, 14, 15, 16, 17, 18, 19, 20, 25, 30, 35, 40, 45, 50, 60, 70, 80, 90, or 100 or more consecutive nucleotides of a nucleotide sequence in a SEQ ID NO including the two nucleotides on each side of such transition. Thus, an oligonucleotide (e.g., primer) according to the invention targeting Exon 3 of the APC gene "comprising 18 consecutive nucleotides of SEQ ID NO:7 including the 5' exon/intron boundary of Exon 3 of the APC gene" would comprise any 18 consecutive nucleotides between (and including) positions 484 and 517 of SEQ ID NO:7, or any 18 consecutive nucleotides of the following sequence: 5'-gtttctattttatt-tagAGCTTAACTTAGATAGC-3' (SEQ ID NO:725; with lower case letters indicating intronic sequence and capitalized letters indicating exonic sequence). At various places in this document Exon 3 of the APC gene is used as an example to illustrate various embodiments of the invention. Those skilled in the art, based on the knowledge in the art and the present disclosure (especially Table 3), can readily and unambiguously apply each example to any gene, exon, or sequence disclosed herein.

Germline deficiencies in the genes in Panels A-Q correlate to increased risk of cancer, including particular cancers as summarized in Table 4. Thus, in some embodiments the method of the invention comprises correlating a germline deficiency in any particular gene in the plurality of genes to an increased risk of a particular cancer as shown in Table 4. In some embodiments the method comprises diagnosing the patient with an increased risk of a particular cancer (or a particular syndrome) as shown in Table 4 based at least in part on a germline deficiency in any particular gene in the plurality of genes. In some embodiments the method comprises correlating no germline deficiency in any gene in the plurality of genes to no increased risk of any cancer (or to no identified increased risk due to the tested genes). In some embodiments the system of the invention comprises a computer program for determining (including quantifying) the patient's degree of risk of cancer (e.g., any particular cancer as shown in Table 4) based at least in part on the comparison of the test sequence with said one or more reference sequences.

TABLE 4

| Gene Symbol | Associated Cancer (e.g., indicator of syndrome or hereditary cancer risk) | Syndrome (if any) |
|---|---|---|
| APC | Colon | FAP |
| ATM | Breast | Ataxia Telangiectasia |
| BARD1 | Breast | |
| BMPR1A | GI | Juvenile Polyposis Syndrome |
| BRCA1 | Breast, Ovarian | Hereditary Breast and Ovarian Cancer Syndrome (HBOC) |
| BRCA2 | Breast, Ovarian | HBOC |
| BRIP1 | Breast, | |
| CDH1 | Breast, Gastric | Hereditary Diffuse Gastric Cancer |
| CDK4 | Melanoma | Hereditary Melonoma (aka Multiple Nevi Syndrome) |
| CDKN2A | Melanoma, Pancreatic | Hereditary Melonoma (aka Multiple Nevi Syndrome) |
| CHEK2 | Breast, Colon | |
| HOXB13 | Prostate | |
| MLH1 | Colon, Endometrial, Ovarian | Lynch Syndrome (aka Hereditary Non-Polyposis Colorectal Cancer or HNPCC) |
| MLH3 | Colon, Endometrial, Ovarian | Lynch Syndrome |
| MRE11 | | |
| MSH2 | Colon, Endometrial, Ovarian | Lynch Syndrome |
| MSH6 | Colon, Endometrial, Ovarian | Lynch Syndrome |
| MUTYH | Colon | MYH-associated polyposis |
| NBN | Breast | |
| PALB2 | Pancreatic, Breast | |
| PMS2 | Colon, Endometrial, Ovarian | Lynch Syndrome |
| PTEN | Breast, Endometrial | Cowden Syndrome |
| RAD50 | Breast | |
| RAD51C | Breast, Ovarian | HBOC |
| RAD51D | Ovarian | HBOC |
| SMAD4 | GI | Juvenile Polyposis Syndrome |
| STK11 | GI, Breast | Peutz-Jeghers Syndrome |
| EPCAM | Colon, Endometrial, Ovarian | Lynch Syndrome |
| TP53 | Breast, Brain, Sarcoma | Li-Fraumeni Syndrome |

In some embodiments the panel of the invention to be assessed in a particular patient depends on the specific cancer(s) or syndrome(s) for which the patient is apparently at risk. For example, as shown in Example 2 below, a patient presenting with indicators of HBOC may be tested for a panel of test genes comprising Panel D (or Panel P) or any subpanel comprising the top 2, 3, 4, 5, 6, 7, 8, 9, 10, 11, or 12 genes of Panel D (or Panel P). Thus, in some embodiments of the methods and systems described above the patient is identified as having one or more indicators of a syndrome listed in Table 4, or otherwise having one or more indicators of an increased predisposition to one or more of the cancers listed in Table 4, and the patient is tested for a panel comprising genes whose mutations are associated with that syndrome or cancer. In some embodiments an indicator of a particular syndrome listed in Table 4 is present when the patient has one or more of the corresponding cancers listed in Table 4 (e.g., an indicator of Lynch syndrome may be endometrial cancer in the patient).

In some embodiments the genes of Panel P may be added iteratively to BRCA1 and BRCA2, which may include reflex testing later genes upon determining the patient is negative for earlier genes. In some embodiments the panel of test genes comprises BRCA1, BRCA2 and CHEK2. In some embodiments, the panel of test genes comprises BRCA1, BRCA2, CHEK2; and any one, two or three of ATM, NBN and/or PALB2. In some embodiments, the panel of test genes comprises BRCA1, BRCA2, CHEK2; any one, two or three of ATM, NBN and/or PALB2; and any one or two of BARD1 and/or BRIP1. In some embodiments, the panel of test genes comprises BRCA1, BRCA2, CHEK2; any one, two or three of ATM, NBN and/or PALB2; any one or two of BARD1 and/or BRIP1; and PMS2. In some embodiments, the panel of test genes comprises BRCA1, BRCA2, CHEK2; any one, two or three of ATM, NBN and/or PALB2; any one or two of BARD1 and/or BRIP1; PMS2; and any one, two or three of MSH2, MSH6 and/or TP53. In some embodiments, the panel of test genes comprises BRCA1, BRCA2, CHEK2; any one, two or three of ATM, NBN and/or PALB2; any one or two of BARD1 and/or BRIP1; PMS2; any one, two or three of MSH2, MSH6 and/or TP53; and MUTYH.

In some embodiments, the invention provides a method of diagnosing increased risk of breast or ovarian cancer comprising (1) identifying the patient as having at least one indicator of a genetic predisposition to breast or ovarian cancer; (2) assaying a sample from the patient to detect one or more mutations in a plurality of test genes comprising at least 3 (e.g., the top 3, 4, 5, 6, 7, 8, 9, 10, 11 or 12) genes in Panel D; and (3)(a) diagnosing the patient as having an increased risk of breast or ovarian cancer if a mutation is detected in step (2) or (3)(b) diagnosing the patient as not having an increased risk of breast or ovarian cancer if no mutation is detected in step (2).

In some embodiments, an indicator of genetic predisposition to breast or ovarian cancer is any of the following:
Personal and/or family history of ovarian cancer;
Personal and/or family history of breast cancer (e.g., diagnosed before a certain age (e.g., 35, 40, 45, 50, 55, 60, 65 or 70));
Personal and/or family history of two primary breast cancers;
Personal and/or family history of male breast cancer;
Personal and/or family history of triple negative breast cancer;
Ashkenazi Jewish descent with personal and/or family history of breast, ovarian, pancreatic, or aggressive prostate cancer (Gleason score of >7);
Personal and/or family history of three or more cancers chosen from breast, ovarian, pancreatic, or aggressive prostate cancer (Gleason score of >7); or
A previously identified mutation in any close blood relative in any of the at least 3 genes from Panel D.

As used above, "breast cancer" includes both invasive cancer and ductal carcinoma in situ (DCIS) and "ovarian cancer" includes epithelial ovarian cancer, fallopian tube cancer, and primary peritoneal cancer. As used above, "personal history" of any of these indicators means patient has been identified as having the indicator (e.g., the patient has been diagnosed as having triple negative breast cancer). As used above, "family history" of any of these indicators means a close blood relative having such indicator and "close blood relative" means a $1^{st}$, $2^{nd}$, or $3^{rd}$ degree relative in either the maternal or paternal lineage.

In some embodiments, the invention provides a method of diagnosing increased risk of a Lynch syndrome cancer comprising (1) identifying the patient as having at least one indicator of a genetic predisposition to a Lynch syndrome cancer; (2) assaying a sample from the patient to detect one or more mutations in a plurality of test genes comprising at least 3 (e.g., the top 3, 4, 5, 6, 7, 8, 9, 10, 11 or 12) genes in Panel E; and (3)(a) diagnosing the patient as having an increased risk of the cancer if a mutation is detected in step (2) or (3)(b) diagnosing the patient as not having an increased risk of the cancer if no mutation is detected in step (2). As described in Example 3 below, the inventors have made the surprising discovery that mutations in BRCA1 and BRCA2 make a significant contribution to patients having Lynch syndrome. Thus in some embodiments the plurality of test genes comprises (a) MLH1, BRCA1, BRCA2; (b) MLH1, MSH2, BRCA1, BRCA2; (c) MLH1, MSH2, MSH6, BRCA1, BRCA2; (d) MLH1, MSH2, PMS2, BRCA1, BRCA2; (e) MLH1, MSH2, MUTYH, BRCA1, BRCA2; (f) MLH1, MSH2, MSH6, PMS2, BRCA1, BRCA2; (g) MLH1, MSH2, MSH6, PMS2, MUTYH, BRCA1, BRCA2; or (g) MLH1, MSH2, MSH6, PMS2, MUTYH, EPCAM, BRCA1, BRCA2.

In some embodiments, an indicator of genetic predisposition to a Lynch syndrome cancer is any of the following:
Personal and/or family history of colorectal or endometrial cancer (e.g., before a certain age (e.g., 35, 40, 45, 50, 55, 60, 65 or 70));
Personal and/or family history of colorectal cancer with MSI High histology (e.g., before a certain age (e.g., 35, 40, 45, 50, 55, 60, 65 or 70)), with examples of MSI high histology including any of the following:
Mucinous
Signet ring
Tumor infiltrating lymphocytes
Crohn's-like lymphocytic reaction
Medullary growth pattern;
Personal and/or family history of colorectal or endometrial cancer with abnormal MSI/IHC tumor test result;
Personal and/or family history of two or more Lynch syndrome cancers, including cases where at least one is before a certain age (e.g., 35, 40, 45, 50, 55, 60, 65 or 70);
Personal history of Lynch syndrome cancer with family history of a Lynch syndrome cancer;
Three or more close blood relatives with a Lynch syndrome cancer; or
A previously identified mutation in any close blood relative in any of the at least 3 genes from Panel E.

As used above, "Lynch syndrome cancer" may include any of the following: colorectal cancer, endometrial cancer, gastric cancer, ovarian cancer, ureter/renal pelvic cancer, biliary tract cancer, small bowel cancer, pancreatic cancer, brain cancer, or sebaceous adenomas. As used above, "personal history" of any of these indicators means patient has been identified as having the indicator (e.g., the patient has been diagnosed as having endometrial cancer). As used above, "family history" of any of these indicators means a close blood relative having such indicator and "close blood relative" means a $1^{st}$, $2^{nd}$, or $3^{rd}$ degree relative in either the maternal or paternal lineage.

The nucleic acids to be analyzed in the methods and systems of the invention may vary in size. Thus, in some embodiments A=10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, or 90,000, or more and B=15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, 90,000, or 100,000 or more. These embodiments include every combination of A and B as set forth in the preceding sentence, where B>A. For example, the nucleic acids to be analyzed may comprise (or consist of or consist essentially of) a range of nucleotides in length from any A to any B (e.g., from 10 to 15, 10 to 20, [ . . . ] 100 to 125, 100 to 150, etc.).

In some embodiments the plurality of DNA molecules comprises at least some length of intronic sequence adjacent to some (or all) of said one or more exons. In some embodiments, the plurality of DNA molecules comprises at least 1, 2, 3, 4, 5, 6, 7, 8, 9, 10, 15, 20, 25, 30, 35, 40, 45, 50, 60, 70, 80, 90, 100, 200, 300, 400, 500 or more base pairs of the intronic sequence on one or both sides of the exon(s). This may comprise some portion of the sequences disclosed herein, using Table 3 as reference for where exons and introns begin and end. For example, in one embodiment the plurality of DNA molecules comprises the exons of, e.g., the APC gene plus at least 20 intronic nucleotides upstream and 10 intronic nucleotides downstream of each exon. For Exon 3 of APC, for example, this would mean the plurality of DNA molecules comprises Exon 3 (nucleotides 501-702 of SEQ ID NO:7) and further comprises the first 20 nucleotides of the intron upstream of Exon 3 (nucleotides 481-500 of SEQ ID NO:7) and the first 10 nucleotides of the intron downstream of Exon 3 (nucleotides 703-712 of SEQ ID NO:7). Those skilled in the art can apply this to the other genes, exons, and sequences referenced in Table 3.

As mentioned above, the nucleic acids to be analyzed in the methods and systems of the invention comprise one or more exons of a plurality of genes. As used herein, a plurality of nucleic acid molecules comprises a sequence or group of sequences if such plurality of molecules together comprises the sequence or group of sequences. Multiple molecules together comprise a single sequence when the non-redundant sequences of the multiple molecules comprise such sequence. For example, a plurality of molecules may comprise the sequence of Exon 3 of the APC gene, which is just over 200 nucleotides long, despite each molecule being no more than 60 nucleotides long. This is true if the non-redundant sequences from the plurality of molecules, when considered end to end, comprise the full sequence of Exon 3. This example is illustrated in FIG. 1, which shows how a plurality of DNA molecules can comprise Exon 3 of the APC gene plus 10 upstream and 10 downstream intronic nucleotides. No single molecule comprises all of Exon 3. When they are aligned, however, the non-redundant sequences of these molecules (underlined nucleotides in Read1 (SEQ ID NO:717) to Read6 (SEQ ID NO:722)) "together" make up a sequence (Composite (SEQ ID NO:723)) that comprises Exon 3 of the APC gene plus 10 upstream and 10 downstream intronic nucleotides (underlined nucleotides of Composite (SEQ ID NO:723)). As illustrated in FIG. 1 (Read1 (SEQ ID NO:717) and Read2 (SEQ ID NO:718)), the molecules to be analyzed may comprise additional moieties that may include additional nucleotides and nucleotide sequences, fluorescent labels, conjugated antibodies or other proteins. Such molecules may still "together" comprise sequence of interest if the non-redundant nucleotide sequences of the molecules end-to-end comprise that sequence.

The total number of genes analyzed in the methods, systems and kits of the invention may vary depending on resource and technical constraints. Thus, in some embodiments W=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 or more and X=3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, or 20,000 or more. These embodiments include every combination of W and X as set forth in the preceding sentence, where X>W. For example, the plurality of genes to be analyzed may comprise (or consist of or consist essentially of) a range of genes in number from any W to any X (e.g., from 10 to 15, 10 to 20, [ . . . ] 100 to 125, 100 to 150, etc.).

The plurality of genes analyzed in the methods, systems and kits of the invention will comprise at least some of the genes listed in Panels A-Q. Thus, in some embodiments the plurality of genes comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 genes listed in Panels A-Q. In some embodiments the plurality of genes comprises gene numbers between Y and Z of any of Panels A-Q. In some such embodiments, Y=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67 or 68 and Z=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69. In some embodiments, said plurality of genes comprises gene numbers 1 & 2, 2 & 3, 3 & 4, 4 & 5, 5 & 6, 6 & 7, 7 & 8, 8 & 9, 9 & 10, 10 & 11, 11 & 12, 12 & 13, 13 & 14, 14 & 15, 15 & 16, 16 & 17, 17 & 18, 18 & 19, 19 & 20, 20 & 21, 21 & 22, 22 & 23, 23 & 24, 24 & 25, 25 & 26, 26 & 27, 27 & 28, 28 & 29, 29 & 30, 30 & 31, 31 & 32, 32 & 33, 33 & 34, 34 & 35, 35 & 36, 36 & 37, 37 & 38, 38 & 39, 39 & 40, 40 & 41, 41 & 42, 42 & 43, 43 & 44, 44 & 45, 45 & 46, 46 & 47, 47 & 48, 48 & 49, 49 & 50, 50 & 51, 51 & 52, 52 & 53, 53 & 54, 54 & 55, 55 & 56, 56 & 57, 57 & 58, 58 & 59, 59 & 60, 60 & 61, 61 & 62, 62 & 63, 63 & 64, 64 & 65, 65 & 66, 66 & 67, 67 & 68, or 68 & 69 from any of Panels A-Q. These embodiments include every combination of Y and Z as set forth in the preceding sentences, where Y>Z. For example, the plurality of genes to be analyzed may comprise (or consist of or consist essentially of) a range of genes with a number from any Y to any Z in any of Panels A-Q (e.g., from 1 to 2, 1 to 3, 1 to 4, [ . . . ] 1 to 55, 2 to 3, 2 to 4, 2 to 5, [ . . . ] 2 to 55, etc.). In some embodiments the genes chosen from Panels A-Q comprise at least some percentage, e.g., 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 60%, 70%, 80%, 90%, 91%, 92%, 93%, 94%, 95%, 96%, 97%, 98%, 99%, or 100%, of the plurality of genes to be analyzed.

In some embodiments the plurality of DNA molecules comprises at least some length of intronic sequence adjacent to some (or all) of said one or more exons. In some embodiments, the plurality of DNA molecules comprises at least 1, 2, 3, 4, 5, 6, 7, 8, 9, 10, 15, 20, 25, 30, 35, 40, 45, 50, 60, 70, 80, 90, 100, 200, 300, 400, 500 or more base pairs of the intronic sequence.

In some embodiments, the plurality of genes comprises the genes in any of Panels A-Q, with the proviso that the genes do not include one or more of BRCA1, BRCA2, PTEN, PALB2, CHEK2, BRIP1, BARD1, CDH1, ATM, RAD50, MRE11A, NBN, RAD51C, TP53, or STK11. In some embodiments, the plurality of genes comprises BRCA1, BRCA2, PTEN, PALB2, CHEK2, BRIP1, BARD1, CDH1, ATM, RAD50, MRE11A, NBN, RAD51C, TP53, and STK11 together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of MLH1, MSH2, MSH6, PMS2, EPCAM, APC or MUTYH. In some embodiments, the plurality of genes comprises MLH1, MSH2, MSH6, PMS2, EPCAM, APC and MUTYH together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of BRCA1, BRCA2, BRIP1, BARD1, CHEK2, MRE11A, NBN, RAD50, RAD51C, PALB2, TP53, PTEN, STK11, CDH1, ATM, MLH1, MSH2, MSH6, PMS1, PMS2 or MUTYH. In some embodiments, the plurality of genes comprises BRCA1, BRCA2, BRIP1, BARD1, CHEK2, MRE11A, NBN, RAD50, RAD51C, PALB2, TP53, PTEN, STK11, CDH1, ATM, MLH1, MSH2, MSH6, PMS1, PMS2 and MUTYH together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of PTEN, PALB2, STK11, CHEK2, ATM or TP53. In some embodiments, the plurality of genes comprises PTEN, PALB2, STK11, CHEK2, ATM and TP53 together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of MLH1, MSH2, MSH6, PMS2 or EPCAM. In some embodiments, the plurality of genes comprises MLH1, MSH2, MSH6, PMS2 and EPCAM together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of MLH1, MSH2, MSH6, or PMS2. In some embodiments, the plurality of genes comprises MLH1, MSH2, MSH6, and PMS2 together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of ACCA, COMT, CYP11B2, CYP19, CYP1A1, CYP1B1, EPHX, ERA, FASL, IGF2, INS, KLK10, MSH6, RAD51L3, SOD2, VDR, XPG, or XRCC2. In some embodiments, the plurality of genes comprises ACCA, COMT, CYP11B2, CYP19, CYP1A1, CYP1B1, EPHX, ERA, FASL, IGF2, INS, KLK10, MSH6, RAD51L3, SOD2, VDR, XPG, and XRCC2 together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of BRCA1, BRCA2, CHEK2, RAD51, or NBN. In some embodiments, the plurality of genes comprises BRCA1, BRCA2, CHEK2, RAD51, and NBN together with at least 1, 2, 3, 4, 5, 6, 7, 8, 9, 10 or more additional gene(s) (including gene number(s) 1, 2, 3, 4, 5, 6, 7, 8, 9, or 10) from any of Panels A-Q.

In some embodiments, the plurality of genes comprises the genes in any of Panels A-Q, with the proviso that the genes do not include one or more of ABL1, AKT1, ALK, APC, ATM, BRAF, CDH1, CDKN2A, CSF1R, CTNNB1, EGFR, ERBB2, ERBB4, FBXW7, FGFR1, FGFR2, FGFR3, FLT3, GNAS, HNF1A, HRAS, IDH1, JAK2, JAK3, KDR, KIT, KRAS, MET, MLH1, MPL, NOTCH1, NPM1, NRAS, PDGFRA, PIK3CA, PTEN, PTPN11, RB1, RET, SMAD4, SMARCB1, SMO, SRC, STK11, TP53, or VHL. In some embodiments, the plurality of genes comprises ABL1, AKT1, ALK, APC, ATM, BRAF, CDH1, CDKN2A, CSF1R, CTNNB1, EGFR, ERBB2, ERBB4, FBXW7, FGFR1, FGFR2, FGFR3, FLT3, GNAS, HNF1A, HRAS, IDH1, JAK2, JAK3, KDR, KIT, KRAS, MET, MLH1, MPL, NOTCH1, NPM1, NRAS, PDGFRA, PIK3CA, PTEN, PTPN11, RB1, RET, SMAD4, SMARCB1, SMO, SRC, STK11, TP53, and VHL together with at least one additional gene from any of Panels A-Q.

As used herein, a "deficiency" in a gene means the presence of some sequence, copy number, expression or epigenetic variation from wild-type in the gene that leads to a deleterious change in function. Sequence variations include point mutations, small (e.g., less than 1,000 nucleotides) deletions and insertions (including frameshift mutations), large (e.g., greater than 1,000 nucleotides) deletions and insertions, and transversions (e.g., reversal of direction in a region of the gene). Copy number variations include amplifications and deletions of substantially an entire gene. Epigenetic variations include variations in methylation, acetylation, etc. In the case of tumor suppressors, a deleterious change in function will generally be attenuated function. Examples include lowered or abolished transcription, lowered or abolished protein expression, and lowered or abolished protein function. Many variations that will lead to such changes may be recognized by those skilled in the art based on the present disclosure, including frameshift or nonsense (premature stop) mutations; deletions, amplifications or transversions in large regions of the gene; missense mutations in critical interaction, structural or enzymatic regions; etc. In the case of oncogenes, a deleterious change in function will generally be heightened function. Examples include heightened transcription, heightened protein expression, and heightened protein function. Many variations that will lead to such changes may be recognized by those skilled in the art based on the present disclosure, including amplification of the gene and activating mutations in enzymatic regions.

As used herein, a "germline" deficiency is any deficiency that is found in the germline of the individual as opposed to deficiencies found only in somatic tissues. For example, a deficiency found in a tumor tissue may either have originated in the germline or arisen somatically. Germline deficiencies may be detected by analyzing various types of samples. Generally, these samples will contain or be derived from cells expected to represent the germline. Examples include white blood cells, germ cells, etc. In some embodiments the nucleic acid analyzed is genomic DNA from such a cell (or DNA (e.g., PCR amplified DNA) derived therefrom). In other embodiments, the nucleic acid analyzed is transcript RNA (or complementary DNA transcribed therefrom) from such a cell. In some embodiments, protein derived from such a cell is analyzed for structural (e.g., amino acid sequence) and functional deficiencies.

Those skilled in the art are familiar with various techniques for sequencing nucleic acids in a sample. Useful techniques include, but are not limited to, Sanger sequencing, sequencing by synthesis (e.g., as described in U.S. Pat. Nos. 6,828,100, 7,276,720, and 7,283,337 and U.S. application publication nos. US20110212437, US20110229877, US20110177498, US20120064599, and US20120058468), single-molecule sequencing (e.g., as described in U.S. Pat. Nos. 8,148,516 and 8,137,569 and U.S. application publication nos. US20110212437, US20110229877, US20110177498, US20120064599, and US20120058468), etc. Examples include techniques developed by Applied Biosystems™ (SOLiD™), Illumina™ (HiSeq™), 454™, Pacific Biosciences™ (SMRT™), and Oxford Nanopore™ (GridION™ and MinION™), each of which is well-known to those skilled in the art.

As discussed above, the methods of the invention generally involve sequencing a panel of genes described herein. With modern techniques, it is often possible to sequence tens, hundreds or thousands of genes. Indeed, it is possible to sequence the entire genome. Once such a global assay has been performed, one may then informatically analyze one or more subsets of genes (i.e., panels or, as often used herein, pluralities of test genes). After sequencing hundreds or thousands of genes in a sample, for example, one may analyze (e.g., informatically) the sequences of a panel or plurality of test genes comprising primarily genes in any of Panels A-Q according to the present invention (e.g., to determine whether a patient has an increased risk of a particular cancer).

As used herein, a patient has an "increased risk" of a particular cancer if the probability of the patient developing that cancer (e.g., over the patient's lifetime, over some defined period of time (e.g., within 10 years), etc.) exceeds some reference probability or value. The reference probability may be the probability (i.e., prevalence) of the cancer across the general relevant patient population (e.g., all patients; all patients of a particular age, gender, ethnicity; patients having a particular cancer (and thus looking at the risk of a different cancer or an independent second primary of the same type as the first cancer); etc.). For example, if the lifetime probability of a particular cancer in the general population (or some specific subpopulation) is X % and a particular patient has been determined by the methods, systems or kits of the present invention to have a lifetime probability of that cancer of Y %, and if Y>X, then the patient has an "increased risk" of that cancer. Alternatively, the tested patient's probability may only be considered "increased" when it exceeds the reference probability by some threshold amount (e.g., at least 0.5, 0.75, 0.85, 0.90, 0.95, 1, 2, 3, 4, 5, 6, 7, 8, 9, or 10 or more fold or standard deviations greater than the reference probability; at least 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 60%, 70%, 80%, 90%, 91%, 92%, 93%, 94%, 95%, 96%, 97%, 98%, or 99% greater than the reference probability).

The results of any analyses according to the invention will often be communicated to physicians, genetic counselors and/or patients (or other interested parties such as researchers) in a transmittable form that can be communicated or transmitted to any of the above parties. Such a form can vary and can be tangible or intangible. The results can be embodied in descriptive statements, diagrams, photographs, charts, images or any other visual forms. For example, graphs showing expression or activity level or sequence variation information for various genes can be used in explaining the results. Diagrams showing such information for additional target gene(s) are also useful in indicating some testing results. The statements and visual forms can be recorded on a tangible medium such as papers, computer readable media such as floppy disks, compact disks, etc., or on an intangible medium, e.g., an electronic medium in the form of email or website on internet or intranet. In addition, results can also be recorded in a sound form and transmitted through any suitable medium, e.g., analog or digital cable lines, fiber optic cables, etc., via telephone, facsimile, wireless mobile phone, internet phone and the like.

Thus, the information and data on a test result can be produced anywhere in the world and transmitted to a different location. As an illustrative example, when a sequencing (or genotyping) assay is conducted outside the United States, the information and data on a test result may be generated, cast in a transmittable form as described above, and then imported into the United States. Accordingly, the present invention also encompasses methods and systems for producing a transmittable form of sequence information for at least one patient sample. The method comprises the steps of (1) sequencing nucleic acids in a sample according to methods of the present invention; and (2) embodying the result of the sequencing step in a transmittable form. The transmittable form is a product of such a method.

Techniques for analyzing sequence data (indeed any data obtained according to the invention) will often be implemented using hardware, software or a combination thereof in one or more computer systems or other processing systems capable of effectuating such analysis.

The sample analyzer in the systems of the invention can be any instrument useful in sequencing nucleic acids, including but not limited to, Illumina HiSeg™, Ion Torrent PGM, ABI SOLiD™ sequencer, PacBio RS, Helicos Heliscope™, or any instrument utilizing a sequencing system discussed above.

The computer-based analysis function can be implemented in any suitable language and/or browsers. For example, it may be implemented with C language and preferably using object-oriented high-level programming languages such as Visual Basic, SmallTalk, C++, and the like. The application can be written to suit environments such as the Microsoft Windows™ environment including Windows™ 98, Windows™ 2000, Windows™ NT, and the like. In addition, the application can also be written for the Macintosh™, SUN™, UNIX or LINUX environment. In addition, the functional steps can also be implemented using a universal or platform-independent programming language. Examples of such multi-platform programming languages include, but are not limited to, hypertext markup language (HTML), JAVA™, JavaScript™, Flash programming language, common gateway interface/structured query language (CGI/SQL), practical extraction report language (PERL), AppleScript™ and other system script languages, programming language/structured query language (PL/SQL), and the like. Java™—or JavaScript™-enabled browsers such as HotJava™, Microsoft™ Explorer™, or Netscape™ can be used. When active content web pages are used, they may include Java™ applets or ActiveX™ controls or other active content technologies.

The analysis function can also be embodied in computer program products and used in the systems described above or other computer- or internet-based systems. Accordingly, another aspect of the present invention relates to a computer program product comprising a computer-usable medium having computer-readable program codes or instructions embodied thereon for enabling a processor to carry out gene status analysis. These computer program instructions may be loaded onto a computer or other programmable apparatus to produce a machine, such that the instructions which execute on the computer or other programmable apparatus create means for implementing the functions or steps described above. These computer program instructions may also be stored in a computer-readable memory or medium that can direct a computer or other programmable apparatus to function in a particular manner, such that the instructions stored in the computer-readable memory or medium produce an article of manufacture including instruction means which implement the analysis. The computer program instructions may also be loaded onto a computer or other programmable apparatus to cause a series of operational steps to be performed on the computer or other programmable apparatus to produce a computer implemented process such that the instructions which execute on the computer or other programmable apparatus provide steps for implementing the functions or steps described above.

One example of a computer system of the invention is the computer system [200] illustrated in FIG. 2. Computer system [200] may include at least one input module [230] for entering patient data into the computer system [200]. The computer system [200] may include at least one output module [224] for indicating whether a patient has an increased or decreased likelihood of response and/or indicating suggested treatments determined by the computer system [200]. Computer system [200] may include at least one memory module [206] in communication with the at least one input module [230] and the at least one output module [224].

The at least one memory module [206] may include, e.g., a removable storage drive [208], which can be in various forms, including but not limited to, a magnetic tape drive, a floppy disk drive, a VCD drive, a DVD drive, an optical disk drive, etc. The removable storage drive [208] may be compatible with a removable storage unit [210] such that it can read from and/or write to the removable storage unit [210]. Removable storage unit [210] may include a computer usable storage medium having stored therein computer-readable program codes or instructions and/or computer readable data. For example, removable storage unit [210] may store patient data. Example of removable storage unit [210] are well known in the art, including, but not limited to, floppy disks, magnetic tapes, optical disks, and the like. The at least one memory module [206] may also include a hard disk drive [212], which can be used to store computer readable program codes or instructions, and/or computer readable data.

In addition, as shown in FIG. 2, the at least one memory module [206] may further include an interface [214] and a removable storage unit [216] that is compatible with interface [214] such that software, computer readable codes or instructions can be transferred from the removable storage unit [216] into computer system [200]. Examples of interface [214] and removable storage unit [216] pairs include, e.g., removable memory chips (e.g., EPROMs or PROMs) and sockets associated therewith, program cartridges and cartridge interface, and the like. Computer system [200] may also include a secondary memory module [218], such as random access memory (RAM).

Computer system [200] may include at least one processor module [202]. It should be understood that the at least one processor module [202] may consist of any number of devices. The at least one processor module [202] may include a data processing device, such as a microprocessor or microcontroller or a central processing unit. The at least one processor module [202] may include another logic device such as a DMA (Direct Memory Access) processor, an integrated communication processor device, a custom VLSI (Very Large Scale Integration) device or an ASIC (Application Specific Integrated Circuit) device. In addition, the at least one processor module [202] may include any other type of analog or digital circuitry that is designed to perform the processing functions described herein.

As shown in FIG. 2, in computer system [200], the at least one memory module [204], the at least one processor module [202], and secondary memory module [218] are all operably linked together through communication infrastructure [220], which may be a communications bus, system board, cross-bar, etc.). Through the communication infrastructure [220], computer program codes or instructions or computer readable data can be transferred and exchanged. Input interface [226] may operably connect the at least one input module [226] to the communication infrastructure [220]. Likewise, output interface [222] may operably connect the at least one output module [224] to the communication infrastructure [220].

The at least one input module [230] may include, for example, a keyboard, mouse, touch screen, scanner, and other input devices known in the art. The at least one output module [224] may include, for example, a display screen, such as a computer monitor, TV monitor, or the touch screen of the at least one input module [230]; a printer; and audio speakers. Computer system [200] may also include, modems, communication ports, network cards such as Ethernet cards, and newly developed devices for accessing intranets or the internet.

The at least one memory module [206] may be configured for storing patient data entered via the at least one input module [230] and processed via the at least one processor module [202]. Patient data relevant to the present invention may include sequence information for one or more of the genes in any of Panels A-Q. Patient data relevant to the present invention may also include clinical parameters relevant to the patient (e.g., age, lifestyle and environmental risk factors for cancer, previously diagnosed diseases (including previously diagnosed cancers), tumor size, node status, tumor stage). Any patient data a physician might find useful in making treatment decisions/recommendations may also be entered into the system, including but not limited to age, gender, and race/ethnicity and lifestyle data such as diet information. Other possible types of patient data include symptoms currently or previously experienced, patient's history of illnesses, medications, and medical procedures.

The at least one memory module [206] may include a computer-implemented method stored therein. The at least one processor module [202] may be used to execute software or computer-readable instruction codes of the computer-implemented method. The computer-implemented method may be configured to, based upon the patient data, indicate whether the patient has an increased likelihood of recurrence, progression or response to any particular treatment, generate a list of possible treatments, etc.

In certain embodiments, the computer-implemented method may be configured to identify a patient as having or not having an increased risk of a particular cancer. For example, the computer-implemented method may be configured to inform a physician that a particular patient has an increased risk of a particular cancer. Alternatively or additionally, the computer-implemented method may be configured to actually suggest a particular course of treatment based on the answers to/results for various queries.

Figure 3:
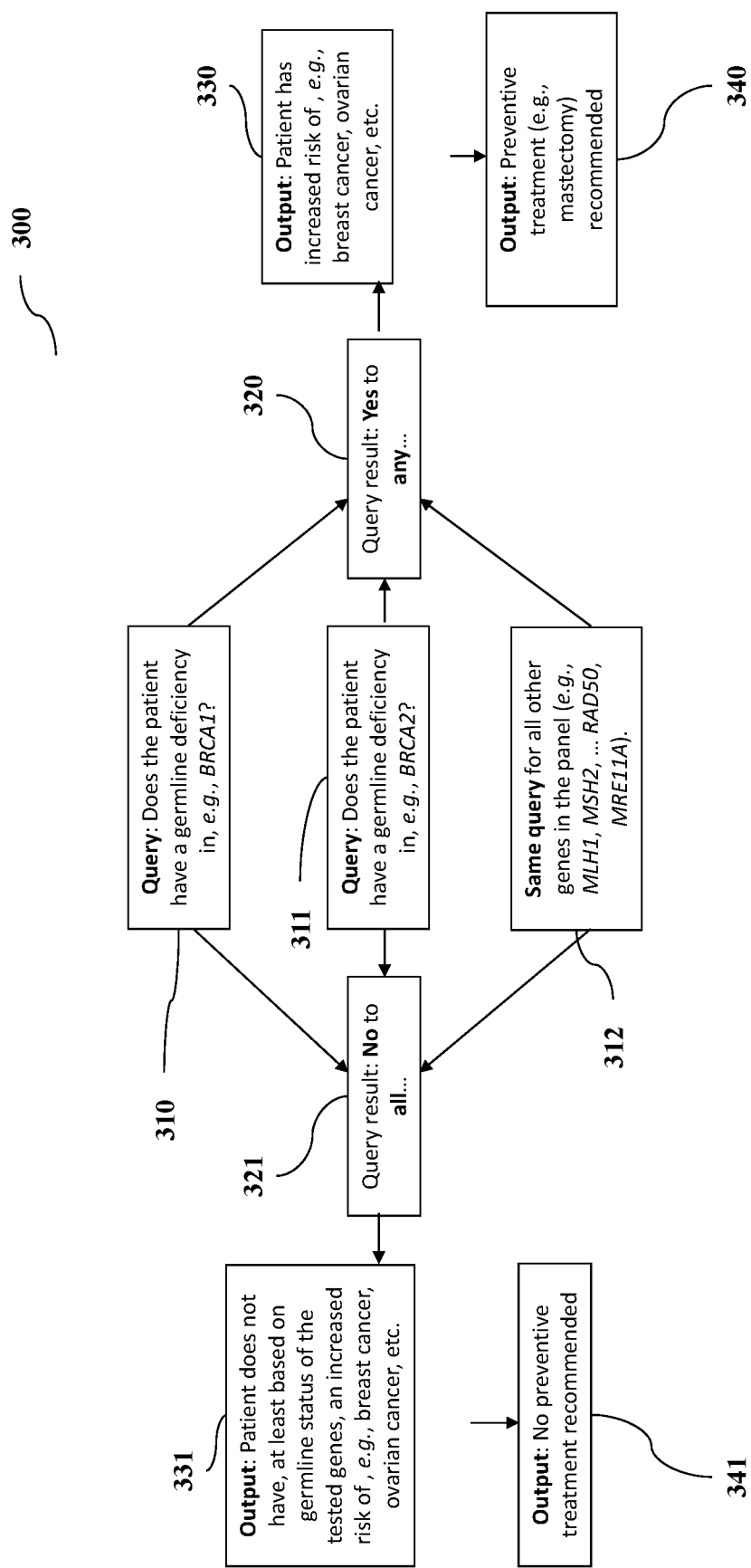
FIG. 3 is a flowchart illustrating an example of a computer-implemented method of the invention.

FIG. 3 illustrates one embodiment of a computer-implemented method [300] of the invention that may be implemented with the computer system [200] of the invention. The method [300] begins with one of multiple queries ([310], [311], [312]), either sequentially or substantially simultaneously. If the answer to/result for any of these queries is "Yes" [320], the method concludes [330] that the patient has an increased risk of a particular cancer (e.g., breast cancer if there is a germline deficiency in BRCA1). If the answer to/result for all of these queries is "No" [321], the method concludes [331] that the patient does not have, at least based on germline status of the tested genes, an increased risk of cancer. The method [300] may then proceed with more queries, make a particular treatment recommendation ([340], [341]), or simply end.

When the queries are performed sequentially, they may be made in the order suggested by FIG. 3 or in any other order. Whether subsequent queries are made can also be dependent on the results/answers for preceding queries. In some embodiments of the method illustrated in FIG. 3, for example, the method asks about BRCA1 [311] first and, if the patient has a germline deficiency then the method concludes [330] or optionally confirms by BRCA2 status [311], and/or other HCG status [312]. Optionally, the method may query clinical parameters (e.g., tumor size, age, tumor stage) before or after querying any of the molecular characteristics of HCGs as shown. As mentioned above, the preceding order of queries may be modified. In some embodiments an answer of "yes" to one query (e.g., [310]) prompts one or more of the remaining queries to confirm that the patient has, e.g., increased risk of recurrence.

In some embodiments, the computer-implemented method of the invention is open-ended. In other words, the apparent first step [310] in FIG. 3 may actually form part of a larger process and, within this larger process, need not be the first step/query. Additional steps may also be added onto the core methods discussed above. These additional steps include, but are not limited to, informing a health care professional (or the patient itself) of the conclusion reached; combining the conclusion reached by the illustrated method [300] with other facts or conclusions to reach some additional or refined conclusion regarding the patient's diagnosis, prognosis, treatment, etc.; making a recommendation for treatment (e.g., "patient should/should not undergo prophylactic mastectomy"); additional queries about additional biomarkers, clinical parameters (e.g., age, tumor size, node status, tumor stage), or other useful patient information (e.g., age at diagnosis, general patient health, etc.).

Regarding the above computer-implemented method [300], the answers to the queries may be determined by the method instituting a search of patient data for the answer. For example, to answer the respective queries ([310], [311], [312]), patient data may be searched for germline sequence data for the HCGs to be analyzed (e.g., the genes in Panel B). The queries may be performed in no particular order or according to some desired order (e.g., in order of gene number in Panel B). If such a comparison has not already been performed, the method may compare these data to some reference in order to determine if the patient has a germline deficiency in any of the HCGs being analyzed. Additionally or alternatively, the method may present one or more of the queries ([310], [311], [312]) to a user (e.g., a physician) of the computer system [200]. For example, the questions ([310], [311], [312]) may be presented via an output module [224]. The user may then answer "Yes" or "No" or provide some other value (e.g., numerical or qualitative value representing germline HCG status) via an input module [230]. The method may then proceed based upon the answer received. Likewise, the conclusions [330, 331] may be presented to a user of the computer-implemented method via an output module [224].

The practice of the present invention may also employ conventional biology methods, software and systems. Computer software products of the invention typically include computer readable media having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. Basic computational biology methods are described in, for example, Setubal et al., INTRODUCTION TO COMPUTATIONAL BIOLOGY METHODS (PWS Publishing Company, Boston, 1997); Salzberg et al. (Ed.), COMPUTATIONAL METHODS IN MOLECULAR BIOLOGY, (Elsevier, Amsterdam, 1998); Rashidi & Buehler, BIOINFORMATICS BASICS: APPLICATION IN BIOLOGICAL SCIENCE AND MEDICINE (CRC Press, London, 2000); and Ouelette & Bzevanis, BIOINFORMATICS: A PRACTICAL GUIDE FOR ANALYSIS OF GENE AND PROTEINS (Wiley & Sons, Inc., $2^{nd}$ ed., 2001); see also, U.S. Pat. No. 6,420,108.

The present invention may also make use of various computer program products and software for a variety of purposes, such as probe design, management of data, analysis, and instrument operation. See U.S. Pat. Nos. 5,593,839; 5,795,716; 5,733,729; 5,974,164; 6,066,454; 6,090,555; 6,185,561; 6,188,783; 6,223,127; 6,229,911 and 6,308,170. Additionally, the present invention may have embodiments that include methods for providing genetic information over networks such as the Internet as shown in U.S. Ser. No. 10/197,621 (U.S. Pub. No. 20030097222); Ser. No. 10/063,559 (U.S. Pub. No. 20020183936), Ser. No. 10/065,856 (U.S. Pub. No. 20030100995); Ser. No. 10/065,868 (U.S. Pub. No. 20030120432); Ser. No. 10/423,403 (U.S. Pub. No. 20040049354).

The terms "probe" and "oligonucleotide" (also "oligo"), when used in the context of nucleic acids, interchangeably refer to a relatively short nucleic acid fragment or sequence. The invention also provides primers useful in the methods of the invention. "Primers" are oligonucleotides capable, under the right conditions and with the right companion reagents, of selectively amplifying a target nucleic acid (e.g., a target exon or gene). In the context of nucleic acids, "probe" is used herein to encompass "primer" since primers can generally also serve as probes.

The probe can generally be of any suitable size/length. In some embodiments the probe is between A and B nucleotides in length. In some embodiments A=10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, or 90,000, or more and B=15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, 90,000, or 100,000 or more. These embodiments include every combination of A and B as set forth in the preceding sentence, where B>A. For example, the probe may comprise (or consist of or consist essentially of) a range of nucleotides in length from any A to any B (e.g., from 10 to 15, 10 to 20, [ . . . ] 100 to 125, 100 to 150, etc.). In some embodiments the probe has a length from about 8 to 200, 15 to 150, 15 to 100, 15 to 75, 15 to 60, or 20 to 55 bases in length. They can be labeled with detectable markers with any suitable detection marker including but not limited to, radioactive isotopes, fluorophores, biotin, enzymes (e.g., alkaline phosphatase), enzyme substrates, ligands and antibodies, etc. See Jablonski et al., NUCLEIC ACIDS RES. (1986) 14:6115-6128; Nguyen et al., BIOTECHNIQUES (1992) 13:116-123; Rigby et al., J. MOL. BIOL. (1977) 113:237-251. Indeed, probes may be modified in any conventional manner for various molecular biological applications. Techniques for producing and using such oligonucleotide probes are conventional in the art.

Probes according to the invention can be used in the hybridization, amplification, detection or sequencing techniques discussed above. Thus, some embodiments of the invention comprise probe sets (including primer sets) suitable for use in detecting, amplifying, quantitating, and/or sequencing HCGs of the invention. In some embodiments the probe sets have a certain proportion of their probes directed to HCGs (e.g., HCGs in any of Panels A-Q)—e.g., a probe set consisting of 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 60%, 70%, 80%, 90%, 91%, 92%, 93%, 94%, 95%, 96%, 97%, 98%, 99%, or 100% probes specific for HCGs.

The total number of genes to which the probes in the probe set are directed may vary depending on resource and technical constraints. In some embodiments the probe set comprises (or consists of or consists essentially of) probes directed to between W and X genes, where W=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, or 55 or more and X=3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, or 20,000 or more. These embodiments include every combination of W and X as set forth in the preceding sentence, where X>W. For example, the plurality of genes to which probes in the probes set are directed may comprise (or consist of or consist essentially of) a range of genes in number from any W to any X (e.g., from 10 to 15, 10 to 20, [ . . . ] 100 to 125, 100 to 150, etc.).

In some embodiments the genes to which probes in the probe set are directed will comprise at least some of the genes listed in Panels A-Q. Thus, in some embodiments the probe set comprises probes directed to at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, or 55 genes listed in Panels A-Q. In some embodiments the probe set comprises probes directed to between Y and Z gene of any of Panels A-Q, wherein Y=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 and Z=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55. In some embodiments, said plurality of genes comprises gene numbers 1 & 2, 2 & 3, 3 & 4, 4 & 5, 5 & 6, 6 & 7, 7 & 8, 8 & 9, 9 & 10, 10 & 11, 11 & 12, 12 & 13, 13 & 14, 14 & 15, 15 & 16, 16 & 17, 17 & 18, 18 & 19, 19 & 20, 20 & 21, 21 & 22, 22 & 23, 23 & 24, 24 & 25, 25 &

26, 26 & 27, 27 & 28, 28 & 29, 29 & 30, 30 & 31, 31 & 32, 32 & 33, 33 & 34, 34 & 35, 35 & 36, 36 & 37, 37 & 38, 38 & 39, 39 & 40, 40 & 41, 41 & 42, 42 & 43, 43 & 44, 44 & 45, 45 & 46, 46 & 47, 47 & 48, 48 & 49, 49 & 50, 50 & 51, 51 & 52, 52 & 53, 53 & 54, or 54 & 55 from any of Panels A-Q. These embodiments include every combination of Y and Z as set forth in the preceding sentences, where Y>Z. For example, the probe set comprises (or consists of or consists essentially of) probes directed to a range of genes with a number from any Y to any Z in any of Panels A-Q (e.g., from 1 to 2, 1 to 3, 1 to 4, [ . . . ] 1 to 55, 2 to 3, 2 to 4, 2 to 5, [ . . . ] 2 to 55, etc.).

As used herein, a probe (or primer) is "directed to" a gene when such probe hybridizes under some minimal stringency conditions (e.g., high stringency conditions) to a nucleic acid comprising a nucleotide sequence specific for such gene (e.g., in the genome essentially only found in that gene).

In another aspect of the present invention, a kit is provided for practicing the prognosis of the present invention. The kit may include a carrier for the various components of the kit. The carrier can be a container or support, in the form of, e.g., bag, box, tube, rack, and is optionally compartmentalized. The carrier may define an enclosed confinement for safety purposes during shipment and storage. The kit many include oligonucleotides directed to (e.g., specifically hybridizing under high stringency to) mRNA or cDNA of a plurality of genes in any of Panels A-Q. Such oligonucleotides can be used as PCR primers in RT-PCR reactions, or hybridization probes. In some embodiments the kit comprises reagents (e.g., probes, primers, and or antibodies) for determining the sequence of a panel of genes, where said panel comprises at least 25%, 30%, 40%, 50%, 60%, 75%, 80%, 90%, 95%, 99%, or 100% HCGs (e.g., HCGs in any of Panels A-Q). In some embodiments the kit consists of reagents (e.g., probes, primers, and or antibodies) for determining the expression level of no more than 2500 genes, wherein at least 5, 10, 15, 20, 30, 40, 50, 60, 70, 80, 90, 100, 120, 150, 200, 250, or more of these genes are HCGs (e.g., HCGs in any of Panels A-Q).

The oligonucleotides in the detection kit can be labeled with any suitable detection marker including but not limited to, radioactive isotopes, fluorephores, biotin, enzymes (e.g., alkaline phosphatase), enzyme substrates, ligands and antibodies, etc. See Jablonski et al., Nucleic Acids Res., 14:6115-6128 (1986); Nguyen et al., Biotechniques, 13:116-123 (1992); Rigby et al., J. Mol. Biol., 113:237-251 (1977). Alternatively, the oligonucleotides included in the kit are not labeled, and instead, one or more markers are provided in the kit so that users may label the oligonucleotides at the time of use.

Various other components useful in the detection techniques may also be included in the detection kit of this invention. Examples of such components include, but are not limited to, Taq polymerase, deoxyribonucleotides, dideoxyribonucleotides, other primers suitable for the amplification of a target DNA sequence, RNase A, and the like. In addition, the detection kit preferably includes instructions on using the kit for practice the prognosis method of the present invention using human samples.

Example 1

Biological samples from patients that can yield germline DNA are obtained. Genomic DNA is extracted from biological samples, purified, and quantitated. Genomic regions of interest (i.e., exons of the genes of interest plus on average 10 flanking intronic nucleotides on each side of each exon) are enriched by amplification using primers specific for these regions. Genes analyzed in this example are those of Panel F.

Genomic DNA is fragmented and subjected to a merge on a RainDance instrument with a target enrichment PCR primer library. The library is designed to amplify approximately 1,200 targets covering all coding regions (plus on average 10 flanking intronic nucleotides on each side of each exon) of the genes in Panel F. Specifically, one micro-droplet at a time, the merging process melds together in an oil phase a micro-droplet containing one or more DNA fragments from the patient sample (or derived, e.g., amplified, therefrom) with a micro-droplet containing thousands of copies of one or more primer pairs targeting widely-spaced unique positions of interest (this example involves 5 primer pairs as one preferred embodiment, but 1, 2, 3, 4, 5, 6, 7, 8, 9, 10, 15, 20, 25, 30, 35, 40, 45, 50, 60, 70, 80, 90, 100 or more primer pairs may be used within a droplet). The process is repeated approximately from 1 to 2 million times. The collection of merged droplets is subjected to emulsion PCR amplification. The emulsion is disrupted, cleaned up, and subjected to secondary PCR that tails the primary PCR products with sequencing primers, anchors and an indexing barcode for the Illumina sequencing process. Samples from one or more patients are pooled together for sequencing (this example involves pooling of samples from 96 patients, but samples from 2, 3, 4, 5, 6, 7, 8, 9, 10, 15, 20, 25, 30, 35, 40, 45, 50, 60, 70, 80, 90, 100, 110, 120, 130, 140, 150, 160, 170, 180, 190, 192, 200, 225, 250, 275, 300 or more patients may be pooled).

Some genes (e.g., PMS2, CHEK2) encompass genomic areas with pseudogenes. Pseudogenes may interfere with normal sequencing. For those genes, genomic DNA is also amplified with gene-specific primers to produce long range PCR products. The long range PCR products are used as surrogate gene targets for sequencing. Specifically, the long range products are amplified with a 4-primer PCR mix containing Illumina adapter-tailed primary nested primer sets specific to the genes, as well as secondary primers containing sequencing chip anchor sequences, indexing barcodes and designed to prime off the Illumina adapter tails of the primary primers.

Amplified DNA is sequenced using the Illumina MiSeg™ (or analogous HiSeg™) system according to the manufacturer's protocol. This system yields high quality sequence data for each exon amplified.

Sequence data are compared to reference sequences using alignment software to determine whether each patient has a germline variation in any of the genes of interest. Further analysis is performed to determine whether any such variation is deleterious, including looking for nonsense and frame-shift variants or large rearrangements.

Example 2

This Example 2 describes a study performed to assess a panel of the invention in a large population of patients suspected of having hereditary breast and ovarian cancer syndrome (HBOC), e.g., patients suspected of having a BRCA1 and/or BRCA2 mutation. The details of DNA preparation and sequencing were as described in Example 1 above, except Panel B was assessed instead of Panel F. DNA from 1955 prospectively accrued cases was anonymized for this study. Patients with Ashkenazi Jewish heritage were excluded in order to determine the relative prevalence of mutations in a generalizable population. Extracted genomic DNA from blood was hybridized with a custom amplicon library on a Raindance™ ThunderStorm™ instrument. DNA was sequenced on an Illumina™ HiSeq2500™ system. Sequence variations, large rearrangements and large deletions among the 25 genes of Panel B were detected.

A total of 275/1955 (14.07%) patients were found to be mutation carriers in at least one of the genes of Panel B. 182/1955 (9.31%) patients had a mutation in BRCA1 or BRCA2. 96/1955 (4.91%) patients had a mutation in other genes. The distribution by gene of 96 probands with other gene mutations is shown in Table A below. The genes of Table A form yet another panel of the invention (Panel P) and these genes, together with the BRCA1 and BRCA2 genes, form Panel D.

TABLE A

Panel P

| Gene # | Gene Symbol | # patients with mutation | (%) |
|---|---|---|---|
| 1 | CHEK2 | 30 | 31.25% |
| 2 | ATM | 14 | 14.58% |
| 3 | NBN | 14 | 14.58% |
| 4 | PALB2 | 13 | 13.54% |
| 5 | BARD1 | 7 | 7.29% |
| 6 | BRIP1 | 7 | 7.29% |
| 7 | PMS2 | 4 | 4.17% |
| 8 | MSH2 | 2 | 2.08% |
| 9 | MSH6 | 2 | 2.08% |
| 10 | TP53 | 2 | 2.08% |
| 11 | MUTYH | 1 | 1.04% |

1738/1955 patients had a personal history of breast cancer. In 1091/1738 the incidence of breast cancer occurred prior to age 50, in 647/1738 the incidence of breast cancer occurred at or after age 50. Mutation prevalence for patients with breast cancer only, ovarian cancer only, breast and ovarian cancer or other HBOC cancers is shown in Table B below. 1902 of 1955 (97.29%) patients had a variant of uncertain clinical significance (VUS) in at least one of the genes tested with a median of three VUSs per patient.

TABLE B

| Patient Cancer History | Patients (n) | Mutation Carriers | BRCA1/BRCA2 | Other Panel B Gene |
|---|---|---|---|---|
| Breast CA <50 years | 1091 | 167 (15.31%) | 116* (10.63%) | 51 (4.67%) |
| Breast CA ≥50 years | 647 | 70 (10.82%) | 40** (6.18%) | 30 (4.64%) |
| Ovarian CA | 162 | 23 (14.20%) | 17 (10.49%) | 6 (3.70%) |
| Breast and Ovarian CA | 40 | 12 (30.00%) | 8 (20.00%) | 4 (10.00%) |
| Other HBOC Cancer | 15 | 3 (20.00%) | 1 (6.67%) | 2 (13.33%) |

*2 and **1 patients had an additional mutation in a non-BRCA1/2 gene.

Panel B (more specifically Panel D) increased clinical sensitivity by 4.76% (95% C.I., 2.71-6.81%) in this study sample of 1955 patients as compared to BRCA1/BRCA2 testing alone. The observed improvement in clinical sensitivity achieved over BRCA1/BRCA2 testing alone is 51.1%. Thus, among cancer patients at risk for HBOC, Panel B (more specifically Panel D) results in a greater than 50% increase in mutation detection over current BRCA1/BRCA2 clinical testing. Panel P and preferably Panel D (or subpanels comprising the top 2, 3, 4, 5, 6, 7, 8, 9, 10, 11, or 12 genes thereof) can therefore be particularly useful in targeted assessment of cancer risk in patients at risk of having HBOC.

Example 3

This Example 3 describes a study performed to assess a panel of the invention in a population of patients suspected of having Lynch syndrome, e.g., patients submitted for testing of mismatch repair (MMR) genes (MLH1, MSH2, MSH6, PMS2, and EPCAM) based on having an indicator of Lynch syndrome. The details of DNA preparation and sequencing were as described in Example 1 above, except Panel B was assessed instead of Panel F. DNA from 343 prospectively accrued cases was anonymized for this study. Extracted genomic DNA from blood was hybridized with a custom amplicon library on a Raindance™ ThunderStorm™ instrument. DNA was sequenced on an Illumina™ HiSeq2500™ system. Sequence variations, large rearrangements and large deletions among the 25 genes of Panel B were detected.

Out of 343 cases, 45 (13%) had a mutation in MLH1, MSH2, MSH6 or PMS2. Out of 298 cases negative for these genes, other deleterious mutations were found as shown in Table C. The genes of Panel Q can be added to the MMR genes to form Panel E of the invention.

TABLE C

Panel Q

| Gene # | Gene Symbol | Cases w/ deleterious mutation | MMR mutation negative cases with other gene mutation # | % of total patients |
|---|---|---|---|---|
| 1 | BRCA2 | 6 | 6 | 1.75% |
| 2 | BRCA1 | 3 | 3 | 0.87% |
| 3 | RAD50 | 3 | 2 | 0.58% |
| 4 | BRIP1 | 2 | 2 | 0.58% |
| 5 | CHEK2 | 2 | 2 | 0.58% |
| 6 | ATM | 2 | 1 | 0.29% |
| 7 | BARD1 | 1 | 1 | 0.29% |
| 8 | MUTYH Bi-Allelic | 1 | 1 | 0.29% |
|  | MUTYH Mono-Allelic | 7 | 5 | 1.46% |
|  | Total excluding MYH mono-allelic | 20 | 18 | 5.25% |

Panel E increased clinical sensitivity by 5.25% in this study sample of 343 patients as compared to MMR gene testing alone. The observed improvement in clinical sensitivity achieved over MMR gene testing alone is 40.4%. To better understand the contribution of BRCA1 and BRCA2 to these suspected Lynch syndrome patients, the type of cancer that was the indicator for Lynch syndrome testing in the nine BRCA1- or BRCA2-positive patients was analyzed. All nine patients had at least on indicator of Lynch syndrome. In four cases, distinct indicators for both Lynch syndrome and HBOC (i.e., indicators not shared between the syndromes) were present. In four other cases, only indicators for Lynch syndrome were present. In one case, only a shared indicator for both Lynch syndrome and HBOC (i.e., ovarian cancer) was present. Even excluding this ovarian cancer case, BRCA2 and BRCA1 alone out of Panel E increased sensitivity by 2.33% over testing only the MMR genes. This translates to an observed improvement in clinical sensitivity over MMR gene testing alone of 17.9%. Thus, among cancer patients at risk for Lynch syndrome, Panel E results in a 40% increase in mutation detection over current MMR gene testing alone. Panel Q and preferably Panel E (or subpanels comprising the top 2, 3, 4, 5, 6, 7, 8, 9, 10, or 11 genes thereof) can therefore be particularly useful in targeted assessment of cancer risk in patients at risk of having Lynch syndrome.

Additional Embodiments

Embodiment 1

A method for sequencing nucleic acids comprising: (1) isolating a plurality of nucleic acid molecules from a sample taken from a patient, each nucleic acid molecule comprising between A and B nucleotides in length, said plurality of nucleic acid molecules comprising one or more exons of a plurality of genes consisting of between W and X genes, and said plurality of genes comprising at least two genes in any of Panels A-Q; and (2) determining the sequence of said plurality of nucleic acid molecules.

Embodiment 2

A method for determining whether a patient has an increased risk of cancer, which comprises: (1) determining for a plurality of genes consisting of between W and X genes, said plurality of genes comprising at least two genes in any of Panels A-Q, whether the patient has a germline deficiency in any genes in said plurality of genes; and either (2) correlating a germline deficiency in any of said plurality of genes to an increased risk of cancer, or (3) correlating the absence of a germline deficiency in all of said plurality of genes to no increased risk of cancer.

Embodiment 3

The method of Embodiment 2 further comprising (a) isolating a plurality of nucleic acid molecules from a sample taken from a patient, each nucleic acid molecule comprising between A and B nucleotides in length, and said plurality of nucleic acid molecules comprising one or more exons of said plurality of genes and (b) determining the sequence of said plurality of nucleic acid molecules.

Embodiment 4

The method of Embodiment 3, further comprising detecting a germline deficiency in a gene by comparing the sequence determined in (b) with one or more reference sequences.

Embodiment 5

A method for treating a patient comprising (1) determining for a plurality of genes consisting of between W and X genes, said plurality of genes comprising at least two genes in any of Panels A-Q, whether the patient has a germline deficiency in any genes in said plurality of genes; and (2)(a) correlating a germline deficiency in any of said plurality of genes to an increased risk of cancer, or (2)(b) correlating the absence of a germline deficiency in all of said plurality of genes to no increased risk of cancer; and (3) recommending, prescribing, or administering a treatment to reduce the patient's risk of cancer.

Embodiment 6

The method of Embodiment 5, wherein said treatment comprises surgery to remove all or part of the organ in which the patient has an increased risk of cancer.

Embodiment 7

The method of Embodiment 6, wherein said surgery is chosen from the group consisting of mastectomy, salpingo-oophorectomy, hysterectomy, colectomy, and prostatectomy.

Embodiment 8

The method of Embodiment 5, wherein said treatment comprises preventive drug treatment.

Embodiment 9

The method of Embodiment 8, wherein said preventive drug treatment comprises tamoxifen treatment.

Embodiment 10

A system comprising (1) computer program for receiving, storing, and/or retrieving a patient's sequence data for a plurality of genes consisting of between W and X genes, said plurality of genes comprising at least two genes in any of Panels A-Q; (2) computer program for querying this patient data; (3) optionally a computer program for comparing the patient's sequence data to one or more reference sequences to determine whether there is a mutation; (4) computer program for concluding whether there is an increased likelihood of cancer based on the presence or absence of a mutation; and optionally (4) computer program for outputting/displaying this conclusion.

Embodiment 11

A system for sequencing genes in a sample, comprising: (1) a sample analyzer for sequencing a plurality of genes consisting of between W and X genes, said plurality of genes comprising at least two genes in any of Panels A-Q, wherein the sample analyzer contains (a) the sample which is from a patient, (b) genomic DNA from the sample, (c) transcript RNA from the sample, or (d) DNA synthesized from said genomic DNA; (2) a first computer program for receiving test sequence data on the plurality of genes; and (3) a second computer program for comparing the sequence data to one or more reference sequences.

Embodiment 12

The system of Embodiment 11, comprising a computer program for determining the patient's degree of risk of cancer based at least in part on the comparison of the test sequence with said one or more reference sequences.

Embodiment 13

The system of Embodiment 12, wherein said computer program for determining the patient's degree of risk of cancer compares the patient's determined probability of a particular cancer with a reference probability to determine whether the patient has an increased risk of such cancer.

Embodiment 14

A composition comprising:
(a) nucleic acid probes hybridizing to a plurality of nucleic acid molecules comprising one or more exons of a plurality of genes consisting of between W and X genes, and said plurality of genes comprising at least two genes in any of Panels A-Q;
(b) nucleic acid primers and primer pairs suitable for selectively amplifying nucleic acids of (a);
(c) antibodies binding immunologically to polypeptides encoded by a plurality of genes consisting of between W and X genes, and said plurality of genes comprising at least two genes in any of Panels A-Q;
(d) a probe set comprising (a), (b) and/or (c); or
(e) a microarray comprising (a), (b), (c), and/or (d).

Embodiment 15

A kit comprising: reagents for sequencing nucleic acid molecules comprising one or more exons of a plurality of genes comprising a plurality of genes consisting of between W and X genes, said plurality of genes comprising at least two genes in any of Panels A-Q; and instructions for using said reagents.

Embodiment 16

The kit of Embodiment 15, comprising a composition of claim 14.

Embodiment 17

The kit of Embodiment 15, wherein said reagents are PCR primers specific for the plurality of genes.

Embodiment 18

The kit of Embodiment 15, wherein said reagents are PCR primers specific for the exons of the plurality of genes.

Embodiment 19

The kit of Embodiment 15, wherein said reagents are oligonucleotide probes specific for the exons of the plurality of genes.

Embodiment 20

The kit of Embodiment 15, wherein said reagents are packaged into an array.

Embodiment 21

The method of any one of Embodiments 1, 3, or 4, comprising comparing the sequences determined in an earlier step with one or more reference sequences.

Embodiment 22

The method of Embodiment 21, comprising correlating a difference between the determined sequences and the one or more reference sequences to a mutation in one or more of the genes in the plurality of genes.

Embodiment 23

The method of Embodiment 21 or Embodiment 22, wherein the reference sequence for any given gene in the plurality is any of the sequences corresponding to that gene as shown in Table 3.

Embodiment 24

The system of any one of Embodiments 10-13, comprising a computer program for determining whether the patient has a mutation in one or more of the genes in the plurality of genes by determining whether there is a difference between the determined sequences and the one or more reference sequences.

Embodiment 25

The system of Embodiment 24, wherein the reference sequence for any given gene in the panel is any of the sequences corresponding to that gene as shown in Table 3.

Embodiment 26

The method of any one of Embodiments 1-9, or 21-23, comprising correlating a germline deficiency in any particular gene in the plurality of genes to an increased risk of a particular cancer as shown in Table 4.

Embodiment 27

The method of any one of Embodiments 1-9, 21-23, or 26, comprising diagnosing the patient with an increased risk of a particular cancer as shown in Table 4 based at least in part on a germline deficiency in any particular gene in the plurality of genes.

Embodiment 28

The method of any one of Embodiments 1-9, 21-23, comprising correlating no germline deficiency in any gene in the plurality of genes with no increased risk of any cancer.

Embodiment 29

The system of any one of Embodiments 10-13, comprising a computer program for determining the patient's degree of risk of any particular cancer as shown in Table 4 based at least in part on the comparison of the test sequence with said one or more reference sequences.

Embodiment 30

The method of any of Embodiments 1, 3 or 4, wherein A=10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, or 90,000, or more; and B=15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, 20,000, 25,000, 30,000, 35,000, 40,000, 45,000, 50,000, 60,000, 70,000, 80,000, 90,000, or 100,000 or more.

Embodiment 31

The method of any of Embodiments 1, 3 or 4, wherein said plurality of DNA molecules comprises at least some length of intronic sequence adjacent to at least one of said one or more exons.

Embodiment 32

The method of Embodiment 31, wherein said plurality of DNA molecules comprises at least 1, 2, 3, 4, 5, 6, 7, 8, 9, 10, 15, 20, 25, 30, 35, 40, 45, 50, 60, 70, 80, 90, 100, 200, 300, 400, 500 or more base pairs of the intronic sequence on one or both sides of the at least one exon.

Embodiment 33

The method of any one of Embodiments 1-10, 21-23, 26-28, or 30-32, wherein W=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 or more; and X=3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, or 20,000 or more.

Embodiment 34

The system of any one of Embodiments 10-13, 24, 25, or 29, wherein W=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 or more; and X=3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 175, 200, 250, 300, 350, 400, 450, 500, 600, 700, 800, 900, 1,000, 1,250, 1,500, 1,750, 2,000, 2,500, 3,000, 3,500, 4,000, 5,000, 6,000, 7,000, 8,000, 9,000, 10,000, 12,000, 14,000, 16,000, 18,000, or 20,000 or more.

Embodiment 35

The method of any one of Embodiments 1-10, 21-23, 26-28, or 30-33, wherein said plurality of genes comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 genes listed in any of Panels A-Q.

Embodiment 36

The system of any one of Embodiments 10-13, 24, 25, 29, or 34, wherein said plurality of genes comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 genes listed in any of Panels A-Q.

Embodiment 37

The method of any one of Embodiments 1-10, 21-23, 26-28, 30-33, or 35, wherein the plurality of genes comprises gene numbers between Y and Z of any of Panels A-Q and Y=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67 or 68 and Z=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69.

Embodiment 38

The method of any one of Embodiments 1-10, 21-23, 26-28, 30-33, 35, or 37, wherein said plurality of genes comprises gene numbers 1 & 2, 2 & 3, 3 & 4, 4 & 5, 5 & 6, 6 & 7, 7 & 8, 8 & 9, 9 & 10, 10 & 11, 11 & 12, 12 & 13, 13 & 14, 14 & 15, 15 & 16, 16 & 17, 17 & 18, 18 & 19, 19 & 20, 20 & 21, 21 & 22, 22 & 23, 23 & 24, 24 & 25, 25 & 26, 26 & 27, 27 & 28, 28 & 29, 29 & 30, 30 & 31, 31 & 32, 32 & 33, 33 & 34, 34 & 35, 35 & 36, 36 & 37, 37 & 38, 38 & 39, 39 & 40, 40 & 41, 41 & 42, 42 & 43, 43 & 44, 44 & 45, 45 & 46, 46 & 47, 47 & 48, 48 & 49, 49 & 50, 50 & 51, 51 & 52, 52 & 53, 53 & 54, 54 & 55, 55 & 56, 56 & 57, 57 & 58, 58 & 59, 59 & 60, 60 & 61, 61 & 62, 62 & 63, 63 & 64, 64 & 65, 65 & 66, 66 & 67, 67 & 68, or 68 & 69 of any of Panels A-Q.

Embodiment 39

The method of any one of Embodiments 1-10, 21-23, 26-28, 30-33, 35, or 37-38, wherein the genes chosen from Panels A-Q comprise at least 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 60%, 70%, 80%, 90%, 91%, 92%, 93%, 94%, 95%, 96%, 97%, 98%, 99%, or 100%, of the plurality of genes to be analyzed.

Embodiment 40

The system of any one of Embodiments 10-13, 24, 25, 29, 34, or 36, wherein said plurality of genes comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69 genes listed in any of Panels A-Q.

Embodiment 41

The system of any one of Embodiments 10-13, 24, 25, 29, 34, 36, or 40, wherein the plurality of genes comprises gene numbers between Y and Z of any of Panels A-Q and Y=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67 or 68 and Z=2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 69.

Embodiment 42

The system of any one of Embodiments 10-13, 24, 25, 29, 34, 36, or 40-41, wherein said plurality of genes comprises gene numbers 1 & 2, 2 & 3, 3 & 4, 4 & 5, 5 & 6, 6 & 7, 7 & 8, 8 & 9, 9 & 10, 10 & 11, 11 & 12, 12 & 13, 13 & 14, 14 & 15, 15 & 16, 16 & 17, 17 & 18, 18 & 19, 19 & 20, 20 & 21, 21 & 22, 22 & 23, 23 & 24, 24 & 25, 25 & 26, 26 & 27, 27 & 28, 28 & 29, 29 & 30, 30 & 31, 31 & 32, 32 & 33, 33 & 34, 34 & 35, 35 & 36, 36 & 37, 37 & 38, 38 & 39, 39 & 40, 40 & 41, 41 & 42, 42 & 43, 43 & 44, 44 & 45, 45 & 46, 46 & 47, 47 & 48, 48 & 49, 49 & 50, 50 & 51, 51 & 52, 52 & 53, 53 & 54, 54 & 55, 55 & 56, 56 & 57, 57 & 58, 58 & 59, 59 & 60, 60 & 61, 61 & 62, 62 & 63, 63 & 64, 64 & 65, 65 & 66, 66 & 67, 67 & 68, or 68 & 69 of any of Panels A-Q.

Embodiment 43

The system of any one of Embodiments 10-13, 24, 25, 29, 34, 36, or 40-42, wherein the genes chosen from Panels A-Q comprise at least 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 60%, 70%, 80%, 90%, 91%, 92%, 93%, 94%, 95%, 96%, 97%, 98%, 99%, or 100%, of the plurality of genes to be analyzed.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference. The mere mentioning of the publications and patent applications does not necessarily constitute an admission that they are prior art to the instant application.

Although the foregoing invention has been described in some detail by way of illustration and example for purposes of clarity of understanding, it will be obvious that certain changes and modifications may be practiced within the scope of the appended claims.

SEQUENCE LISTING (725 sequences)

SEQ ID NO: 1 - DNA, 10814 bp, Homo sapiens
agtcttcccacctcccacaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcaaaaaaaaaaa

SEQ ID NO: 2 - DNA, 10848 bp, Homo sapiens
gtattggtgcagcccgccagggtgtcactggagacagaatggaggtgctgccggactcggaaatggggacacatgcattggtggccaaaagagagaggagacaaaaccgctgcagatggctgatgtgaatctagtggaaagagctactggggatgagagaaagaggaggaggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcaaaaaaaaaaa

SEQ ID NO: 3 - DNA, 10740 bp, Homo sapiens
gtattggtgcagcccgccagggtgtcactggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcaaaaaaaaaaa

SEQ ID NO: 4 - DNA, 1500 bp, Homo sapiens
tgaataaaatccaacttcttaccatgacctggaggccctacctgatttggcctctgcctaccccgaccacatctccttcccactgtccatgtcacctattctttctgtccctctttcatgtcagacttgctaccacctcaggatctgttctgttgttccctctgtctgaaagcttttgccccagatcttccagtggctcctgggcccccatggtcagtcaggcttcagattaaatgtcaactctggagaaagatcactaatcaccacctctcactgtccatcatctttctgtgtggtttgctctcttcctatcccttatcaccatcaaacattcttttgttgactgtcttttattgtctattctttcacactagaatgtaagttccgtgagtttattgtatttcctattgctgtaaatctagagcctgaaacagtatctagtatatatcggaaacccaaatgatattgttcaattaatgttgaatgaaatgaaactgaagaggtaatccaaggtaaagaacttatcaaactgtgtgagacaaacaaggatttcccggaagaggtgtttttaaattaaaactacagggtggtagtgagaggtggtagggaagcagaggtcgcagctacaaaataataacttgctcatctccgtttctccgctatcttatgagcccttgtggggctgggacagaattttattcatctttctatcatcagcgtctagtacggggagtagcaaatagtgagcactcgatagatgtttgcggaataatggactagtgtgtgcagaaggatctattaactgggctgcagcacaattcagagaaggccagtaagtgctgcaactgagactcggctgcctaggcagcaatggctcacgggacagaacagcgaagcagtgcccggcaagcggagcgcagcacccattgcgcctgcgcataacaggctctagtctccgggctgtgggaagccagcaacacctctcacgcatgcgcattgtagtcttcccacctcccacaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtgagtgaggctgcaggcattgacgtctcctcccggcaaagcttcctcggctttgccccgccgctgctcgggaccctacggtgctcggcccgactctgtggctctcttctctccatgtctca

SEQ ID NO: 5 - DNA, 1378 bp, Homo sapiens
aggtaatccaaggtaaagaacttatcaaactgtgtgagacaaacaaggatttcccggaagaggtgtttttaaattaaaactacagggtggtagtgagaggtggtagggaagcagaggtcgcagctacaaaataataacttgctcatctccgtttctccgctatcttatgagcccttgtggggctgggacagaattttattcatctttctatcatcagcgtctagtacggggagtagcaaatagtgagcactcgatagatgtttgcggaataatggactagtgtgtgcagaaggatctattaactgggctgcagcacaattcagagaaggccagtaagtgctgcaactgagactcggctgcctaggcagcaatggctcacgggacagaacagcgaagcagtgcccggcaagcggagcgcagcacccattgcgcctgcgcataacaggctctagtctccgggctgtgggaagccagcaacacctctcacgcatgcgcattgtagtcttcccacctcccacaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtgagtgaggctgcaggcattgacgtctcctcccggcaaagcttcctcggctttgccccgccgctgctcgggaccctacggtgctcggcccgactctgtggctctcttctctccatgtctcaccctctcccctccccgcactccccattcaggcctccagttggcccctggctttgcaggtcctccattctcacgcagtggatgggggtcgcgacgcccgccgtcctccacctttcctggctgctgctggagcttcgcccctgcaagtggtgccccattcgcgttaggtgggtgggtcgtccgcccttcccattttagtcgcttccccatcttcctcgtttggaccctcttgcttcctctaaaagttttaaactctctgcctgggaaaatacctgatagcccggcatgtggagttacaaagaaagggctgttatccaaaggccggtgaattttgttcactttgatgggagaatcaagtccccaggagccttggatggtta

SEQ ID NO: 6 - DNA, 1085 bp, Homo sapiens
atgctaattgtaaattagtatactagcagaatatacttaaatgtggtatataaaagcttgaatgttgaagttgttaaatagattatgtgttaatttggtgttttttatggtcatgttggtgcacgcttaagagacatggattctaaacacataagtagcttttgtaacttgagcaagtctctgggtctcacttgttttatctgaaaaatgagaataatttgcattgttggtttttaggtttgaaataatgaatgtatcttaaatgtgtttctaataccttgcacagagactccccataatcaccattatctcaaaatatcactattattatttggccatgatttatttattaataatgaataataggtaatatatataaggtgcgtgctttgagagtgatctgaatttttttctcagcatacttaaatgtcaagaaatacagaatcatgtcttgaagttatttagaatttcatgttaatatattgtgttctttttaacaggaagtacttaaacaactacaaggaagtattgaagatgaagctatggcttcttctggacagattgatttattagagcgtcttaaaggtagattttaaaaaggtgttttaaaataattttttaagctcaaattgtcatctttaggtgtgtagatccaagtacagcttctctcgatttgggtgttggtatcagttttcttggtatgttagccttaccctcaggatgtaattgttaaagtacaaataaataaaaaatgtatttgtgtgtcatttcttcagttaaacatttaactggctttgaatgaactattttaaatccctcccttaaataattttcggctctttgtaaagcttgttgctattctgccagtcactaaatagggctttagtattctatatgccatagacttgagcctactgtttcattggaagaagtattgtcttcttcattcaggatagaaatactttaaccttttcacatatataagttgattataattcatttttagcagttttaaaaggatatctttctcattctgttgcttgaaaattccagtgtcagaacagagaaagtgcttgataataatt

SEQ ID NO: 7 - DNA, 1202 bp, Homo sapiens
ccagtcactaaatagggctttagtattctatatgccatagacttgagcctactgtttcattggaagaagtattgtcttcttcattcaggatagaaatactttaaccttttcacatatataagttgattataattcatttttagcagttttaaaaggatatctttctcattctgttgcttgaaaattccagtgtcagaacagagaaagtgcttgataataattgaagccagacagagaaattacttttggattctaaaatattatttagaggaagtctaaggaagtacattttatctaattttcctttaacacactccttatttttaccctgacccaagtggacttttcagggaaagtcctaaataatttttgttttcagtcatgtatatttgtggttaaaatgtaaacctaatatttcactttaaaataatataacattaagaatattttagactgcttaaagcaattgttgtataaaaacttgtttctattttatttagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtaacttttcttcatatagtaaacattgccttgtgtactccagtttattgttattttgtaatataatatttaaattgtgaatttatagtaggtgatagctaacacttagagcattttgcatttttaaactcaaagatagcatgttattgattgcacttacattaaatctaaaaatataaacaaggccgtttcctgggattctgaagacctattttgtcacttattttgtttttttgtttgttttttggggtttattttgagacagggtgtcactgtgtctcccaggctggagtgtagtggcatgatctcggctcactgcaacctccacctcctgggttcaagcggttcttgtgcctcagccacccaagtagctgaaactatagacgcctaccaccacgcctggctaatttttgtatttttggtagagacggggtttcttcatgttggccaagctggttatcacttaaatactttgactactctgtacattgagtaataca

SEQ ID NO: 8 - DNA, 1109 bp, Homo sapiens
taacttcctcttatttcaaaatgacagtatatttcttattattttggctgctgtgaagctgaaagccacatcagtgtccaaagtaatagcttcttatattctgggtttgttttctgggcatcattgctgcttttcttatttcctttactatactttttattcttatattaattttgagttttgttatatgtgtatcttttacctatcattatattcttagactataaatatgaagaaagcctttggtgaagtgtaagtattcttttaaggatgattaccagtttatttagaaaaaaagttctttttaatactctaattttaatgactgtaatattctaagtcctacctttaaaaattgaaatcaatgtaaattttttgagtaattcattattagcactttaggtagagaagtttgcaataacaactgatgtaagtattgctcttctgcagtctttattagcattgtttaaacgtacctttttttaaaaaaaaaaaaataggtcattgcttcttgctgatcttgacaaagaagaaaaggaaaaagactggtattacgctcaacttcagaatctcactaaaagaatagatagtcttcctttaactgaaaatgtaagtaacttggcagtacaacttatttgaaactttaataacttgatattttaaagtacctaggtaatccattaaaattcaggataactgaatttatagttatttgtaaattgcaatatgttttacccaactttaggcctgaatatataatagttaatgaatttttgttggtaaagatgataaaactttattgtgctcaaatgttttatttaaagctcttatttagaaaatctataaagtttgaattctagaggacctcagggttcaactaggcaactagttttttaactccgtgtattgaattgccaaacatactctatagaaatatttatcaccatctgcctattttttgtactgtgttgcaggaatcatgccaaatagtttttgcaataaaaatatctctgaaaatattctagatataaatgccaatagctatagcacggatattagcatttttgcaagcactaaagctggtttgttttgtccaccagtattcacaa

SEQ ID NO: 9 - DNA, 1114 bp, Homo sapiens
catattcctcatttgattaatgaaaaagttctctcaacttaatctgtatgtatatggtaatccttaccttaagttgaagtatgagcttaagaatgatggacttgtttcttgatatttctatgttgtccacgttaatatgctagtatttaataattaaaagtagtgcctcttcagtagagaagagtcataaggcaactgaatttaacctcactctaactggaccaattatatattttaagtgaaataggccaatctaattaaagccacttgtgactttggcaaataagtgtttgaattccacgtcacatcagggatccagattgagtctgacacctataatcaaatttaaacactccttggagtaaaaaataattttctcatgcaccatgactgacgtatttgcttattcattttctttattggttcttatatgcttttttgcttttactgattaacgtaaatacaagatattgatacttttttattatttgtggttttagttttccttacaaacagatatgaccagaaggcaattggaatatgaagcaaggcaaatcagagttgcgatggaagaacaactaggtacctgccaggatatggaaaaacgagcacaggtaagttacttgtttctaagtgataaaacagcgaagagctattaggaataaaatgaattacagctctgttaatattgattaaattttattaaagacataaggctgtgtttattttggctctatttcaaaataagatttatcatggctgctgagcaacataatcaatattcacatagttgtgtctttaccatattcatttcccctggtactgttctgttctgccttggaattataagggagagacagagttagatggtggtcttccggtagctaatgactagcttcagttctcctttgaaatttttacttcttgtaatcttagactgtataaaggcattcagaacatgtcactgctcttcaaattgtgcacttaaaaaaccctcattcaaggataataggaaggaaacaaagagaattttaggagagatgaagtaagttgtatggagaacattcccatatttctaccctcaatgtcaagaaagagtattagctagctttgc

SEQ ID NO: 10 - DNA, 1105 bp, Homo sapiens
cagaagctaagagcctatcattttatttcacctaacttttattagaagatatacatatatatatatatattctatgtgaaaatatacctaagtagaagatatttgtaagcttaggtaatagtttaactgttgtatttgcagctccattaaatgtcagaatcatgtgtccttgcagaaaagatagttatttgttctacttgggttatgttcctgatagtaatgtgagcgcagctggtagaggatggcattcctgtgagtctcagaaaatcctttgtctcgtgcagctctaatgctcaagggacacacttcactttccccttaccgagatagtcgaccgccaatcgtactggaggttatgaagtgtaatacacagttccatgcctttatcagtctgtataattgatgcattcagagctttaaagcaaaaaaagaaaaaaagccttgggctaagaaagcctacaccatttttgcatgtactgatgttaactccatcttaacagaggtcatctcagaacaagcatgaaaccggctcacatgatgctgagcggcagaatgaaggtcaaggagtgggagaaatcaacatggcaacttctggtaatggtcaggtaaataaattattttatcatattttttaaaattatttaaatatcagaaaagtatgaagcaagatggttctaagaatgatctataaatcttacctattttcttagtcctgaatgcatatttccagaagcattcagtaccaatgtgctgtcatttctctttattatatcagcaataatgctgtaaggattttctagatctatttctatagctatagattgtgtgtttatgttttagtctaaaatgattgtgagtagttttttttaataactctaagctgcattttgattatgtatatgatttgacctagttatttttgcttgccttgaataggtttgctctttcactaagaccttcaatgtaaagacatttttatggttttttttaaagttataaaggctttatttcctgttgtacttaaagattatataaatctagaaatccaagtcttactgaaaaagataattgtaatgcacacaaaaaagtaaggcaacatggccta

SEQ ID NO: 11 - DNA, 1099 bp, Homo sapiens
ggtgtttatattatactgcactgcagtcatttattttttcatgtctttgtccagtaaaagttttaaacagccctttctaaactgtgagatcttagagaacttggactgtagcaaattcatacttagttttctggcaatttggagcatttcagaatttgaacattccttcaatgcttttcatcaatgaacttatctgaatgtggttttatttatttagatctatgaaaaattactaccctagaatttcttcagtctttggttaagtccattctgcagtttaatgctcatatgcaagaaactctcttttctttagtttttctctaaaacatacttagtaagcgtataggtaaaaaatattttgaacagttataatggtcatacttttatgatgtatttaattgtttatcatacagacacttcatttggagtaccttaacatgatgttatctgtatttacctatagtctaaattataccatctataatgtgcttaatttttagggttcaactacacgaatggaccatgaaacagccagtgttttgagttctagtagcacacactctgcacctcgaaggctgacaagtcatctgggaaccaaggtaacagaagattacaaaccctggtcactaatgccatgactactttgctaagacattcttggccaggtgcagtggctcacacctgtaatcccagcattttgggaggccaaggcaggtggatcacttgaggccaggagttcaagaccagcctgggcaacgtggcaaaaccccatctctactaaaaatacaaaaatttagccagtgtggtggcacacacctgtggtcccagctactcaggaggctgaggcatgagaatagttggaacccaggaggcagaggttgcagtgagctgagattacaccgctttctagtggagaattctgattcacagtctcttgaagaaattacatatttttatacaacgaagcataaacaagggaaaaatcaggtttataaaaagtgccagattagctaatttttaattctttttcagtctttacatccacttttctgcaagaatactgagttccagccaaactggctcacttcctgcttcctga

SEQ ID NO: 12 - DNA, 1379 bp, Homo sapiens
gacgagaattaatgattgctgagaattagtacttaaaattgttgcagaaatgttttctgtttattgcttataggtatagattaaaagaaataagataaagttttaaattatgtaaagatttagataaactacattctctatgtgtgtgaaatccgttgtttttcactgattatagtcagtggattagcaccaacttatctaggcaaacagcactaacagtttgttagtgagtatgcaaaaacctacttttgcttttaatactgtatattaccactcatactatttactcacataaacaaattggtgatgatacatagattttgaaataacactgattacttcatcctggaaaggttttccggttttttgttttttttttggcggggggggttgttttgtttttttagagttatagtaaatatcccattcatcacttaattggtttttggcttttggatattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaagtatgttctctatagtgtacatcgtagtgcatgtttcaaagcaaatgtgaaatttttaaacagaaaacatgtttagttaatatgctgtctttatgactaagaggagaaaattcatatcagccatttgtgctactcatatttaaaagattaagtctgtatttccctagaaaaatttagcaaaggaaaatgttatgtgcactactataagaacagtaagtcaagagaaatttatacaatcatagcatagtagggccttagtagagctagaaagaacttgagcaattatgttgcccatctttcacttcatagctgaagctcatttcatagatgaaagtgactttacgtaagttcctatagccattagtgtccaaaccataatcttttacatttgcatatcattatattcaggggatacagagcagcgttacatctgttatgttatttgctcctcacatcaacctactgaagtaggaagggaaggtattatcatctccatttta

SEQ ID NO: 13 - DNA, 1096 bp, Homo sapiens
gctccggaagctgaggcaggaaggtcaattgagcccaggaatacaaggctgcggtgaaagctatgatcattccactcgagcctgggcaacagagcaagaccctgttttgttttttttttgttgtttttttaaagaaagaaagaaattataaacaaaattaaaccattttataccaaaatatttttattattttgtatactcaacataattttaagttattagctatatgagtaatagcataaacctcctagacttattctaagagacttagtcaagggcagatgagtggtaaacatttttatggaaacaaatccctttattcctattttttgttccacatttgtagtatttattcatcctttcagcaaatatttgttgatccactaaaattccgtgaattagggttatattagtgatccctgcatatttttaaagtacaataaacatcattgctcttcaaataacaaagcattatggtttatgttgattttatttttcagtgccagctcctgttgaacatcagatctgtcctgctgtgtgtgttctaatgaaactttcatttgatgaagagcatagacatgcaatgaatgaactaggtaagacaaaaatgttttttaatgacatagacaattactggtggatttttaaatcatggtagaaattcagtatagtaaataaagatttttaatcattgatgaattaggatataaggccaccaacttctgttatcagctgcttcctctgtgtagcaaaaaattgtaccctggtttccagcatagaaaggatcctgaatcacagaaactgctaccctgtcataagctaactttttcaaaatcgaagccggagattgaaaaaaaatgacaaaatgggtcactctttgtcccttttgccaaagtagactctatatgtgccagctgatgaggatggtaatttgaattattttgaaatgtggagctgctgtattgtgattgaactcagtcacttttgatgagcatcagagggaattattattaagattgtcatttatcttcatggttattggtactttacaggattttcatcataagcagcctggtatctttgaaattggttaata

SEQ ID NO: 14 - DNA, 1140 bp, Homo sapiens
tttttagtttttcttcatgcacagtttcatttaaaggcatccgtattcctaagggtaattatttgccaaaaaaaaaaaattaaagtagttaggccacagtgtatgacaataaagagtgtttataaagccctaataataataataagttacctttttctgcttatgttcacgaagaactagtgttagaaaatagccttcttcactgttggcaaggtgcagtgtatatgcagtaaatagaaaataattatttcgctcagcaagataaggggctgggggtggagaaactggcataaaatggaataattgtcagttgtactttataaatatattatacagaagttctttataacagtttttgtagcttataattctaaaggcaaatttaaaccatatattctcattgattgagtttttttttcctagtatttaagttaccaacttggtaccagtttgttttattttagatgattgtctttttcctcttgccctttttaaattagggggactacaggccattgcagaattattgcaagtggactgtgaaatgtatgggcttactaatgaccactacagtattacactaagacgatatgctggaatggctttgacaaacttgacttttggagatgtagccaacaaggtatgtttttataacatgtatttcttaagatagctcaggtatgagttaatttactttcatacaaatacattttactgattttcttttttttcactctcctcattaaacaatgactgataaaaacctgtgcttcacattcgcttatctttactcatttgtttgtcttatgcctaaacaaaggcaaaggtacatctacagatggaacacagtagtgaatttatgtaattgcattaaaaacaccattcataagaatatacttgtagggatcatttctgtgatccattactagagaagtttaactgtgtagaattaaaaaataaaagataaaacacttcctaggaatgggattaaaaatctaaaaattcttaagaccaaggcaagtgttacacacacattgattccatccaaataagaggctttactctaaaacctgttgcttatcatttctcaccacttattcactttatttctctagtttgacaaaggaagaacagatagca

SEQ ID NO: 15 - DNA, 1078 bp, Homo sapiens
caaaggtacatctacagatggaacacagtagtgaatttatgtaattgcattaaaaacaccattcataagaatatacttgtagggatcatttctgtgatccattactagagaagtttaactgtgtagaattaaaaaataaaagataaaacacttcctaggaatgggattaaaaatctaaaaattcttaagaccaaggcaagtgttacacacacattgattccatccaaataagaggctttactctaaaacctgttgcttatcatttctcaccacttattcactttatttctctagtttgacaaaggaagaacagatagcaaagaattaggagaatatttgtcttttatttaggtaatcttattctagattttttatgagtgaagtatcagttatgattaaaacaaaataatgaaaactgaattagacatttagtagccaaaaataaagcttggcttcaagttgtctttttaatgatcctctattctgtatttaatttacaggctacgctatgctctatgaaaggctgcatgagagcacttgtggcccaactaaaatctgaaagtgaagacttacagcaggtactatttagaatttcacctgtttttcttttttctctttttctttgaggcagggtctcactctgtcacccaggcttagagggcagttgtgcaatctcagctcactgcaacctctgcctccagggttcaagcaatcctcccacttcagcctctcgaggctgggcctacaggtgcacaccaccatgccaaacgaatttttgtattttttatagagacggggtttcaccacacctgggctcaagcaatctgcccacctcagcatctcaaaatgctgggattacaggcgtgtgccaccacacccagctaatatcctgatttagattgttgctcagtatttagtatctcatgtataaaagatagttccattaacactagaaaaagaaaaataattatattgtggttagactgtaggaaatctttttggcactgtagtagcatttaggaggaatttaaaaaaaaaaaaaaaaacaggatctccctctcttgcccaggctggagtg

SEQ ID NO: 16 - DNA, 1117 bp, Homo sapiens
ataaaagatagttccattaacactagaaaaagaaaaataattatattgtggttagactgtaggaaatctttttggcactgtagtagcatttaggaggaatttaaaaaaaaaaaaaaaaacaggatctccctctcttgcccaggctggagtgcagtggtgcgattatggctcacagtaacctcaagctcctgggatcctcctgcttcagcctcccaagtagctagaactactgcaggcgcatgccaccatgcccagctaatttttaaaaagttttcatagagacagggtctcactgtgttacccagaaggtcttgaactcctggtctcaggagatcctcctgcctcagcctcccaaagtgataggattacaggcgtgagtcaccacggctagccagaatttctttcttaatagatttctattcttactgctagcattaaaaacaaaaaagcaactagtatgattttatgtataaattaatctaaaattgattaatttgcaggttattgcgagtgttttgaggaatttgtcttggcgagcagatgtaaatagtaaaaagacgttgcgagaagttggaagtgtgaaagcattgatggaatgtgctttagaagttaaaaaggtacctttgaaaacatttagtactataatatgaatttcatgtttggcttttttttgctgccttcttttagccatgagatttcctaatttcttacctgtgtattattcagtactataatatgaatttcatgtttagctttttttgctgccttcttttagccatgagattccctaatttcttttttgagatggggtctctttctctcgcccaggctggagtgcagtggtctgatcttggctcactgcaacctccgtctcccatgttcaagtgattctcctgcctcagcctcctgagtagctgggattacagtgcacgccaccactcccggctatttgtatttttagtagagatggggtttcaccatgttggtaaggctggtctcgaactactcctgactttgtgatctgcccaactcggcctcccaaagtgctgggattataggcgcaagccatcacgcccagcctagattccctaatttcttacctgtttatctcaccagt

SEQ ID NO: 17 - DNA, 1215 bp, Homo sapiens
gcgaggctggtcttgaactcctgacctcagatgatccacccgtcagcctcccaaagtgctgggattacaggcatgagccactgtgcccggccacatgccgggccttaatccacttcctgttcacttttttttttcttttttcaagcaaccccagcctgagaataacccacattctattctgaaaatgttttcttttcataatgcacatcagttgtgcctcatattctaagatgtgtgtactatctaaacacttagaataaagtttataaaagtcattagttaaatattgtgttctgcttgttttatagagatatcactgatataaatactatttggtattttatgaacatttttctaaatggaaagttcttaatttaccagtgagggacgggcaataggatagattaaaaaatagcttttattcaatatcagtaacatagaagttaatgagagacaaattccaactctaattagatgacccatattctgtttcttactaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggtatatatagagttttatattacttttaaagtacagaattcatactctcaaaaagacctaattgtaagcaatgttttatataatcatgaaagttttaagccaaaatatatttattactgtgaaaagataactactaactcttagtttaactcattagtgtacttaatgtaataacagtttatagtattatagaggagactaaattaagcaaattatagttgagaggtgtagcccataggtggaggaaaaaatagtcacaaatattgtaacaaaataatccatttctattagtatagtataaaagagtatgaaaacaaaatttagaacaagacaaaaactatgagcgtgatccagagaatataaaggttcacatttttctaatgatgtcttagtatccataataataattttttttttttttttttgagacagggtctcactctgtctcccagactggagggcagtgttgtgatcttggctcactgcaacctccacctcct

SEQ ID NO: 18 - DNA, 9687 bp, Homo sapiens
gagattactctaaaaagtaagtgttctaatctaagagcttataatgtgcactgactgcagaaaaatcttcaatcaattctatctacctcttccaagataactcaatatcaatatcagagtggcacccaaccatagattaaattaccacaaagttcctattcaacataggatttcatgatatagtttttaaattgggaaactgttatatgaatagagtaaatgtatgtgccccaccccctgcaaatgttttaagctattgggtcagaataggaaatgtagaattgacaaaaaataacacctttactttttttagtgtgacagattagtactttaaaacattaaacattacatgaaattagaacaaaaggagatgtggaatacttggaatttataggataattggtacaatcatattatgccttttgtcttctatccttttatttgttgttactgcatacacattgtgaccttaattttgtgatctcttgattttatttcaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatataggtcatactggtttcctttcattttttgattttctatttctaattttctgaattactgcatgccagttgttgcaaaccacttcaagtacttctatggaaagagatggatgttagtcaattagataaacttgccttttaattcaaataaggaagaaaatataaatgctgaaaatgaacattccacatgccagaaaagtggaatttttgtaggcaacacttgagtggggggagacgggccagtctatactacccattgaagtaaagactgctggatgaggccctctgttagagatagtggttctgaattagtaaaggggcaaatctcaattctaattatagatgttcacagggtgctgctataatcgatagcaggccaaatattcccagtttatgcttgttaacaaatggcatactaagcccagcgttgggaattagtcaggagttacgatgcctgtttagagaggagtgggggagggagagttacctaacgtaaggc

SEQ ID NO: 19 - DNA, 1500 bp, Homo sapiens
taagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatataggtcatactggtttcctttcattttttgattttctatttctaattttctgaattactgcatgccagttgttgcaaaccacttcaagtacttctatggaaagagatggatgttagtcaattagataaacttgccttttaattcaaataaggaagaaaatataaatgctgaaaatgaacattccacatgccagaaaagtggaatttttgtaggcaacacttgagtggggggagacgggccagtctatactacccattgaagtaaagactgctggatgaggccctctgttagagatagtggttctgaattagtaaaggggcaaatctcaattctaattatagatgttcacagggtgctgctataatcgatagcaggccaaatattcccagtttatgcttgttaacaaatggcatactaagcccagcgttgggaattagtcaggagttacgatgcctgtttagagaggagtgggggagggagagttacctaacgtaaggcacttcaaaggagtgcgttgggatcaccaggagtgcttaacaagacatagctgggccatacccccagtttgattcaggatgtttggaatggggcctaagaacttgcatatctaacaagttcaaaggtgaggctaatgctgctggtctggagaccacactttttgagaattactgccctaagatcacagtgaagctccttgagtggttgccttcagctctagcgattcctcccaacaactggacccttaatctgacaaagtatagcaacagataaaagacttcccctaggcataaaagatttcaatattaagccatccaatttcataatgctcatctcaactcctgacagcagacaaacttagccagacatgaacaaacaagtaattctaaagacagtgattatatttgaaggatcagttaatgttccctttgagactgtcattataaaaagcagtaacttcagcaaagatctaatttgaattttcaataagattaaaagac

SEQ ID NO: 20 - DNA, 13147 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 21 - DNA, 1500 bp, Homo sapiens
tccctcctcaaatgaaggtaaaactagggctagaaaacgttcaactaatttaaggcaattaaccctctgaaatttttcgctgatcaaaggaacaggaattgctgttttaaaatatgcaactggcatttcacacctctacactggacgacgtattgcgtggaggatggagaaggaagatcacccctactcccaaattcgtagttataagggcgggttattagaagggcgccaggaaggtctctctacaaagatggggggccggggaactccctatttgccctattttggtcccaacactgaaccaaggaaattgcgcccaaggttgaagcacacgcaatccgtccgtcatgcagacaaatgctctttcaggggtcctaattaagtgtggaggcctgactttccttccgaatccgccccaggtgttccaccccgagcttcccctcgggcttcccctcgccacgcagcctctgaagagaggagcatctacatacaaagaggcttaaactgcccagaacctccgaatgacgaagaatcaccgccagtctcaactcgtaagctgggaggcaaaaccccaaagcttccctaccaagggaaaacctttggcctcaaaggtccttctgtccagcatagccgggtccaataaccctccatcccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcct

SEQ ID NO: 22 - DNA, 1355 bp, Homo sapiens
taaactgcccagaacctccgaatgacgaagaatcaccgccagtctcaactcgtaagctgggaggcaaaaccccaaagcttccctaccaagggaaaacctttggcctcaaaggtccttctgtccagcatagccgggtccaataaccctccatcccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccag

SEQ ID NO: 23 - DNA, 1102 bp, Homo sapiens
agctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattata

SEQ ID NO: 24 - DNA, 1113 bp, Homo sapiens
gctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggtt

SEQ ID NO: 25 - DNA, 1146 bp, Homo sapiens
attttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacag

SEQ ID NO: 26 - DNA, 1165 bp, Homo sapiens
gcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctca

SEQ ID NO: 27 - DNA, 1166 bp, Homo sapiens
cagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgt

SEQ ID NO: 28 - DNA, 1239 bp, Homo sapiens
ccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagtt

SEQ ID NO: 29 - DNA, 1164 bp, Homo sapiens
ctagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttg

SEQ ID NO: 30 - DNA, 1170 bp, Homo sapiens
taaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatacttt

SEQ ID NO: 31 - DNA, 1372 bp, Homo sapiens
ggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaa

SEQ ID NO: 32 - DNA, 1195 bp, Homo sapiens
tattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatgg

SEQ ID NO: 33 - DNA, 1096 bp, Homo sapiens
agtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaagga

SEQ ID NO: 34 - DNA, 1226 bp, Homo sapiens
gtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaa

SEQ ID NO: 35 - DNA, 1126 bp, Homo sapiens
catgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggac

SEQ ID NO: 36 - DNA, 1126 bp, Homo sapiens
tgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacac

SEQ ID NO: 37 - DNA, 1090 bp, Homo sapiens
ttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatca

SEQ ID NO: 38 - DNA, 1172 bp, Homo sapiens
tttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacaga

SEQ ID NO: 39 - DNA, 1200 bp, Homo sapiens
aatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatg

SEQ ID NO: 40 - DNA, 1083 bp, Homo sapiens
aggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaat

SEQ ID NO: 41 - DNA, 1156 bp, Homo sapiens
agtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcac

SEQ ID NO: 42 - DNA, 1076 bp, Homo sapiens
ctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtg

SEQ ID NO: 43 - DNA, 1131 bp, Homo sapiens
atataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattcttttttttttttttttttttt

SEQ ID NO: 44 - DNA, 1118 bp, Homo sapiens
agttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttaca

SEQ ID NO: 45 - DNA, 1174 bp, Homo sapiens
ttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatc

SEQ ID NO: 46 - DNA, 1170 bp, Homo sapiens
ctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaat

SEQ ID NO: 47 - DNA, 1247 bp, Homo sapiens
accaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgt

SEQ ID NO: 48 - DNA, 1116 bp, Homo sapiens
aatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgaca

SEQ ID NO: 49 - DNA, 1127 bp, Homo sapiens
taagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctagga

SEQ ID NO: 50 - DNA, 1200 bp, Homo sapiens
ctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagc

SEQ ID NO: 51 - DNA, 1175 bp, Homo sapiens
ttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataatttttt

SEQ ID NO: 52 - DNA, 1165 bp, Homo sapiens
tcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctcaaaaaaaaaaaaaaaaaatatatatatatatatatatatatatgtgtgtgtatataaacacatacttgtgtgtgtgtaacgtgagatctacctacttaag

SEQ ID NO: 53 - DNA, 1133 bp, Homo sapiens
atgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaa

SEQ ID NO: 54 - DNA, 1096 bp, Homo sapiens
atttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtat

SEQ ID NO: 55 - DNA, 1172 bp, Homo sapiens
tttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatt

SEQ ID NO: 56 - DNA, 1142 bp, Homo sapiens
aatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagt

SEQ ID NO: 57 - DNA, 1177 bp, Homo sapiens
caccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctc

SEQ ID NO: 58 - DNA, 1178 bp, Homo sapiens
agaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttg

SEQ ID NO: 59 - DNA, 1088 bp, Homo sapiens
atcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgt

SEQ ID NO: 60 - DNA, 1156 bp, Homo sapiens
agtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatattt

SEQ ID NO: 61 - DNA, 1088 bp, Homo sapiens
ttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagaatacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctca

SEQ ID NO: 62 - DNA, 1089 bp, Homo sapiens
ttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatata

SEQ ID NO: 63 - DNA, 1103 bp, Homo sapiens
aacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggatt

SEQ ID NO: 64 - DNA, 1149 bp, Homo sapiens
ccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctattttaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgatttttttttttttgcctctctcctcattctaaacaacaactgtttttctcttctatgaatataacaggagttgttttatatatatatatatatatatatatatatatatatatacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggat

SEQ ID NO: 65 - DNA, 1105 bp, Homo sapiens
tcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctag

SEQ ID NO: 66 - DNA, 1120 bp, Homo sapiens
tcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttt

SEQ ID NO: 67 - DNA, 1235 bp, Homo sapiens
ggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagtttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtc

SEQ ID NO: 68 - DNA, 1168 bp, Homo sapiens
aaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactgg

SEQ ID NO: 69 - DNA, 1114 bp, Homo sapiens
tgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttctt

SEQ ID NO: 70 - DNA, 1218 bp, Homo sapiens
caggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcaca

SEQ ID NO: 71 - DNA, 1208 bp, Homo sapiens
cttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatag

SEQ ID NO: 72 - DNA, 1114 bp, Homo sapiens
taagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacg

SEQ ID NO: 73 - DNA, 1159 bp, Homo sapiens
tgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagtt

SEQ ID NO: 74 - DNA, 1139 bp, Homo sapiens
tctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtat

SEQ ID NO: 75 - DNA, 1083 bp, Homo sapiens
ctagtctctaagtatgcttctaagtatctccccatactttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaat

SEQ ID NO: 76 - DNA, 1141 bp, Homo sapiens
ttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggg

SEQ ID NO: 77 - DNA, 1117 bp, Homo sapiens
catgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtat

SEQ ID NO: 78 - DNA, 1150 bp, Homo sapiens
ttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttaca

SEQ ID NO: 79 - DNA, 1166 bp, Homo sapiens
aaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccct

SEQ ID NO: 80 - DNA, 1087 bp, Homo sapiens
atacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcag

SEQ ID NO: 81 - DNA, 1115 bp, Homo sapiens
agcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactac

SEQ ID NO: 82 - DNA, 1064 bp, Homo sapiens
ctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggac

SEQ ID NO: 83 - DNA, 1137 bp, Homo sapiens
gccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaa

SEQ ID NO: 84 - DNA, 4775 bp, Homo sapiens
catccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacgaaaaggcaaatatgaatgttctttctttgggcctagaaagtgatctagttgacatttctagcctaaaagatctgtactagaatatgacaagtgcaaagatcctggtatcctaaatgcaaagttttttacctgtttatcatatttttaaaataaattcagtcctctggagttttagtctcttttgcctagattttaacaaaatgcattttgcataaatatagtggagtcaaagtttccacaaagattataatgactca

SEQ ID NO: 85 - DNA, 1500 bp, Homo sapiens
gcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacgaaaaggcaaatatgaatgttctttctttgggcctagaaagtgatctagttgacatttctagcctaaaagatctgtactagaatatgacaagtgcaaagatcctggtatcctaaatgcaaagttttttacctgtttatcatatttttaaaataaattcagtcctctggagttttagtctcttttgcctagattttaacaaaatgcattttgcataaatatagtggagtcaaagtttccacaaagattataatgactcagaatttggtaagtaaggagatctcataatagacattatcctctgaaaaatccctttgccattaaaagtacagcatacacagttttatgtacaacagtatgtagaaatatatactttcattgtgtatgatccaaaagcagtggttcttaaccaggggtgattttgctgcctcacttgatattttcaaaataaagttattgttattttgatgggaacaaaatggtatcatgtctcattttaatttgtacctcactaattactagggagattaaatgttttagtatacacttgttagtcagtatgattttctctgatgaactgcctgtacgtattctttgctgatatttctactgatcctttgttggttatgtaacatcttagctaacatcttttccaattctgtagcttgtctcttcattctcttaatggagtttttttggttgacagacatttttattagtgttttcattaaggttaaatctttcaggtagggattttccc

SEQ ID NO: 86 - DNA, 2593 bp, Homo sapiens
cctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatca

SEQ ID NO: 87 - DNA, 1500 bp, Homo sapiens
ggttgctctgtaggtcttatctgtaaattacggcgatcagtgaaagatctggaggaggaaggtggacacactctctaacaaaaaaaaccctttttgaaattttataccaatattttaaaagtaaaccagatcttttcagacatgcctttgagctgatatttgttaactagttagaattagaaactttccttatttttactcagttacaatatacgccacagctgaggtgagaggaaagaaaaggttgctttcttaggaacaaagagtggtaccttcagtatcgtgggcaaagcttttccaagtccaacagcagtcaaaacagcgctttttataaataacactcagctaaaagtttctgggtttgtgattgttccaacggttaagctcggatgagggtccctggagtcgtagctcccgggaaacgtcgactggctttccacctggacttcatccgtccaggcagcccagaggggcttcaggccccgcccgctctcctgccaactacagcctcgcgactgcgctcagccttcaggccccgccccttcggtcaagcggcgtgctctcactgcacggcgcctgggccccgcgcgccgggacctcggtttcagccgtcctgtcctgccccgaggcccctaggccccgcccctgggccccgcgcgccaggacttcggtttcgaccgtcctgtcccgccccgaggctcctaggccccgccccctctgtccccggcgtgttctcgcggctccgcccctaggacccgcgcgccgggactttggcaagtttcagccgtccggccccgccccctcggtcccacggctctcgcggcccctcccctaagtcccacacgccgggactttggcaagtttcagcctccagccccacccctaggtcccgcccactcggccagcggctggctctcgcggccccgcccctgtgccctgcgagtccctattttgggagcattgcggccgccgtgccccgcccctccccgcgcgccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttggtaaagacggagcttcttgggggtggctgcgagggcacgggtcgcacagtttctgggggcggcagaatcttttcaaatcttccgtttcctccttccgttcccgcgctgcagtcgggtcggcgtgcggttagcacctgccgggggatatagtattaacaacttctgcttctcattcactttatttttgggcgacttaccggcctcccc

SEQ ID NO: 88 - DNA, 1293 bp, Homo sapiens
actacagcctcgcgactgcgctcagccttcaggccccgccccttcggtcaagcggcgtgctctcactgcacggcgcctgggccccgcgcgccgggacctcggtttcagccgtcctgtcctgccccgaggcccctaggccccgcccctgggccccgcgcgccaggacttcggtttcgaccgtcctgtcccgccccgaggctcctaggccccgccccctctgtccccggcgtgttctcgcggctccgcccctaggacccgcgcgccgggactttggcaagtttcagccgtccggccccgccccctcggtcccacggctctcgcggcccctcccctaagtcccacacgccgggactttggcaagtttcagcctccagccccacccctaggtcccgcccactcggccagcggctggctctcgcggccccgcccctgtgccctgcgagtccctattttgggagcattgcggccgccgtgccccgcccctccccgcgcgccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttggtaaagacggagcttcttgggggtggctgcgagggcacgggtcgcacagtttctgggggcggcagaatcttttcaaatcttccgtttcctccttccgttcccgcgctgcagtcgggtcggcgtgcggttagcacctgccgggggatatagtattaacaacttctgcttctcattcactttatttttgggcgacttaccggcctccccttgccctgaatccaactgaaacggtagtttttgaacttcagcgggctgaagaaccgtctggaggtgtggctaaaaaaatgttcatcccggtcgcgcctccagagtttgaatcgggctggggtggggctgaggcttctgcattttttacccggccctggattaccccgctgctttccgggagctgtggcgaattgggctggcgggccgccccggagaccctctaaattagaagcagctgccactctaagttaaactggcctttttgacattttctccgtgccagctttttcgag

SEQ ID NO: 89 - DNA, 1057 bp, Homo sapiens
cagtcctggtttattcctgttgtcccagcatcctattcaattatcactcctcttcactctcagaagttttctcatttggatgatacgttatatggtcattctacgtgtgggacacattttgaggtatatggtctacactttgaatcataaggggaagatacaccttagtagttgaaagaagcagccagtagttggttttgccttaagaggtttagagatacttgaacaaaattgttcctttctccaactttctagaaaatacattttaaaatgtattacaacttgtacccagtttggtggttactatttaaaatcatcaggtatgttatggtacaatatttaaccagggagtaacagcctttcaaatgaatgcatccttaataccttctgctttgagaaagtgagaaatatggtagtgttgggccttggatgaaatattgggtgtgagatgtttatctaacaatgactcaaatcttgattgttttaatttcttcaaacagtactaacattctgagagagcctgtgtgtttaggaggatgtgagcacatcttctgtaggtaagtaattacggtttgatgtatatagtacaactgtattttttactagataacaatcatgtaatcttgttgataataatggtacttgatgtttgtgtaactttcaaagtctgcaaagtaacctattgtacattatcttagtttgatctttaaaactgtgtcttaatttacaaataagaaaaccaaagctcaaagaggatgacttgtccaagttacaaagcttagtagacagctttgccaaattggaggaaaaaaattaatgccttttatataattcaaatagatgtttttaaattttccagttaaattttgaatctagactcaaaattgtgaaagtataggtcttacagttattatattagtttcctaaggctgccataacaaagaaccaaaaactgggtggcttagaacaacagaaatgtattgtctctctagttctgtaggctaggagtctaagatcaagatgatgacagggttggttccttctgtgggctgtgagg

SEQ ID NO: 90 - DNA, 1149 bp, Homo sapiens
gataacccaggtaattgagtctacaggttttaaaattgtctgaaaaagtcaaagatcttttcccaaaagctactttaaagccttgagatactagtcccaaaacaaaacagaaggtctttcccagtgtctgcagtagttttgggtattttcatgcaatgttaagatagaaaaagttaggatgcacgactactatgcattaggcattctatctttctgttacatctctgtaacctttagaagctacagatttatttgtagggaaaattatgcagactaataatcaggctaagtaaagtctcttcatagcaaattacatgagcaaccttagatttgatgtatgtattttactctttaaaacagtattcaacaaggatattacaattgaccattgtatgttagaataacctctgctccatttatttctgttcaaactgtttagtttttggaattaaattctgctgaatgggttgcttttttttttttttttaattattttaaagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcaggtaagaactatccctatctctcttagttaaattcatcagttaaaaactgatgaattcatattcataaagtatataaaacatctatctggagttctggaatacgtatttcagattttaaaatctgtaggttttttttttttttttttaaatagccattgagtctctctatgttgtccaagccggacttgaactcctgcactcaagggattccccccacctcagcctccctggtacatgcatgtgacacacccggtggttttttggaagatcattttgagaaatgacgggaaccatagagataattaaagtctaacccccttattttatagttgagaaatcaaggtccagagaggtgaaataaccttgcctacagccgcatgtgtagttagtactagaagctggagaaataaagcccatttctgactgtaaatccaggaacttttttgctgctttacattgcctgctttttacatttatgataacttctgcagaatatatat

SEQ ID NO: 91 - DNA, 1950 bp, Homo sapiens
tttccgtgtaaattttataattgcttgtcgagttttacaaacaagcctactggaaattacattgggatttgttatatctgtaaatctgtttggaacaattggcatcttaacaatattgttatagttcatgaacatggtatatctctccatttgtgtagaattctttaataagtattttgtaattcttagcaaacagaacttatacattctgttagatttgtattttatgggtttttttgggtactatatttggaatataagtttcatgttttgttctctgctatatcttcagtctctaggatatggcacaaagtcggattcagtaagtattgaatgagtgaatatctgctatcaaagagttcacactctaggagctgagaaagaagtacataattaaaagatgatacactttaggggaactgtaaacaaaattcttcgggagctccatgtgggagcaataaatttcatgtaacagatttctttttctttttttctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaaggtaggatgcttactctgaaataccatctcagaatgaggccaactataaagcaatttctttgcagtttttgaaaaatggcataggattactaggataattaacctttcacagacatgatacttcctctgaaccagagaagccagattcatagggagagcatctctacttcagttggagcagtggcccctgagtctgggcgcatgatcttgtaggagaaaaccaatatttgaatatttcggcttttattttgccaagtgcttttgcttttgtctattttaccttcagtttttatcattttgtttacctgtcttcatgctttatgaatgtagacaattgctaagttattacaggcaacaatgtttacttagtaaaaaagcccatatttaccatccaaattcaaccaaaatttggaaggttgaaagatgtggtctgtacatttctccaatgaccgggacatttgactatcagaaatggctcctccagttcaccacaaaggagct

SEQ ID NO: 92 - DNA, 1081 bp, Homo sapiens
aagcatgactgtacttcttgatatctcagaataatttatacgcagacaatttcttttttgttttgtttttttgagacggagtcttgctctgtggcccaggctggagtgcagtgacatgatcttggctcactgcaacctctgcctcctgggctcaagtgattctcctgcctcagcctcccaagtagctgggattacaggctggcaccaccatgcccgactagttttgtatttttagtagagacggggtttcaccatgttgaccaggctggtctcaaactcctgacctcaggtgatccacccaccttggcctctcaaagtgttgggattacaggcgtgagccaccacacccggcctaataatttattaactcatgaacagtagccttaagagaaaacgatttaagttttactttatattgaagaaggcagcatttaaaaaagctcaatattttcctttctttccttaatgctttttaatttccgttttgttcatttttctagggcgacataccttctgttgaataccttttacaaaatggaagtgatccaaatgttaaagaccatgctggatggacaccattggtagttgtctggtttttattctcattctttctgtgttttacagttcttatagtttatagttatgtagttgtctatatatcatcctctgccacatatactctttttagtctgaagaacttatgttttcatcaagtatgagaacatgattactttccttctagcttttcatttgtgacaggcaagaaattggttaccttttgacagactacctttagatttaggaatccatttgtactgtactgcagaatttagctaatgtctagaggtaacagctacagctgacatcaggctccattctgtagcactgcatgtcactggaaccaaatttcttggaacaaaaagaggtcggaggaactgagtataggaaagtgatcacaaggaagtaattctcactgagggtctatcttagcctcacttataccctatccaattgtagatatataaggcagtagaaatctttgcttacattaaacatttttaaaggtctttgcttattatta

SEQ ID NO: 93 - DNA, 1173 bp, Homo sapiens
tcctactcgtgttatttctcttatcaataacagcagccatacagcaatttgtaggttcagcaaatagcttatcttaaaagcattccttcacggatacttactttgttgcatgatatgtgtatgtactggtacagattttatgtatcatcttgttattaaatatgtagacttttttcttaatgtgttacatttattgtagaacatttaaggagctaccgttggtttaaaactacattttcttctaaaaaacagaaaagtgcttgacccaaggctcaaatgagaatagcctttctttttttatgagttacacagatcttgattgaaagattattaatagtaactttcactctgtcagcaacttatagtgtttttgagtatttaggtaacaataaatttactgcctgacgtttacatttatttttctaaagtgtgatattataatatcatccattgctctttcttatcacttctttcacttctttttcaaaaaatttaattagcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgtgtaagtagttcaacgtaaaaattatttttaaaatggacctatattcttgaatcaaggtgtgtgataaagcagactttaaaatagtcaagttgatggctttcttcactttcacaactaaaattagatgtgatcatcacattctgcactcataatcagccttcatgccctttttatgatacagttggtccttcatattcttgggttctacacttgaggattcagccaactgcagatcaaaaataattgggaaatatcaatgacagatcggataaaaaaaatgtgttacatatataccatggaatactatgcaactacaaaaaagaatgagatcatgtttttttgtgggcacatgatggagctggaggccattatccttagtaaactaacgcatgaacagaaaaccaaataccgcatgttctcacttataagtgagagctaaatgatgagaattcatgaacacaaagaagggaacaacagacaccagagtctacttgagtgtg

SEQ ID NO: 94 - DNA, 1109 bp, Homo sapiens
ttgtatgcacacatgtttaaattaatttttaaagtaccctgttaactatattattaaactgtttgttatgtggcataattttccttctagtagaacaaaatccctgtcctgtgaatttatctaattttttattggtttataaagactatatggcctataatagctatagtaaatgatttttattggcatttgaaagtctgtcacttatagtgattggtgattatgaagccatattttaatatgaataagaatgcagaatacagttgtgaaaaattcataatactatattcagtaaaaacaatccctataatctgatgtcaaactgaaattttacatcatttctcctttgagttcagcagcttttgattctagattcttctgcctaatatgagttctgagtaatttattttagttaaaattgtatattattaaggatgttgaaaaattgagtcgagtcacacatttgacttacttaaacacatctgcacttattttaccagtaatatatttggtctgcggcctgtcgattatacagatgatgaaagtatgaaatcgctattgctgctaccagagaagaatgaatcatcctcagctagccactgctcagtagtaagtatggatttagctttgggacatttatatattttattaaaattggttatgaaaggaacataatagaaaaatttccatttgaccaattgcttacattcaccaaacaattattgagcacttcctgagtattagctactgtggattcaaagacataatcacagtacgaccatctagaaatacttattgagcccactctgtattttaggcagcattcataaaacaatgaatatgactggtagaactcttattctcagggaggagcttaccatctggtgagaggtaggaaagagacaaactgtaaatattgaactaatataaataaaataatttcagacacttagacatgagtgtttcgaagatgttgtagagtgtcgttgggtggaggtagtgggcttctgcaaggccattgctttagctagggtcacagagtggagccttaaagcactgatttgaattgaagcctgaatgttgaagtgaggaggctgccaggtgactat

SEQ ID NO: 95 - DNA, 1133 bp, Homo sapiens
gttttgaggggttactattttgatgctaatttgttttctatctttgaggtcagcactgttctagaagccttggcattctttgatttttcagataatctcagtttaaactaaacaagtttgattttaactctattgggacaagttagtggaggtggaatagggaattgctgattttaagtggatattttaagttacttgggaaaagaaaaagacttactggtgactgaatgaagtaaaaccctagagagacccaatttaaaattgaagaaatgagatgccctgggtatagagagctatcacaattgacattttcttgagggaaaaataaagagaaaaaatttatttaaaaggttctgggtgtagattcaatggaaataattgaaaattattagagtaaactaagtaatgaaattcaagcttatatcaagtaacagtctgtttaatgtctttgtctagtcgtctaatgtttttaacactggtatctccttttatattaacagatgaacactgggcagcgtagggatggacctcttgtacttataggcagtgggctgtcttcagaacaacagaaaatgctcagtgagcttgcagtaattcttaaggctaaaaaatatactgagtttgacagtacaggtgaggattttgaattttgggaggtggggtagaaaaaatgttaaatagatgatccttttggagaactacctttgataatttacatatgttttaaccattgggagatggctgtatactttgcatcttgtaatacatctaaattttttttcagtaataaactacttatagacaacaacgtagttaggaaatgtaaagtttaaaggtttgcatatattttaggacaagacagtatttcagaagagcaaatttgtgacttttgctagtgacaaataaattgttgtgcagtgtaatgtcataatcccttagctgtaatttgaaaataaaaatttgtgtttgccaatatggctttaagatatatggtttatgatctgatttttcatattgatggccaggttagagaactagatactaaatagaagtagtcttacacttaagtgtaaaaattgttgcctttgaagattcagatataagcttacaaaatatagatgagttataagaag

SEQ ID NO: 96 - DNA, 1093 bp, Homo sapiens
gaactacctttgataatttacatatgttttaaccattgggagatggctgtatactttgcatcttgtaatacatctaaattttttttcagtaataaactacttatagacaacaacgtagttaggaaatgtaaagtttaaaggtttgcatatattttaggacaagacagtatttcagaagagcaaatttgtgacttttgctagtgacaaataaattgttgtgcagtgtaatgtcataatcccttagctgtaatttgaaaataaaaatttgtgtttgccaatatggctttaagatatatggtttatgatctgatttttcatattgatggccaggttagagaactagatactaaatagaagtagtcttacacttaagtgtaaaaattgttgcctttgaagattcagatataagcttacaaaatatagatgagttataagaagcaggccaaagaaatactttggcttgtatctttctttctcttactgctttttttgtattttagtaactcatgttgttgttcctggtgatgcagttcaaagtaccttgaagtgtatgcttgggattctcaatggatgctggattctaaaatttgaatgtaagtgttggatttgagagaattaagaaatgaattagactagttttgtttttcatggttattaatgcctgtgattaaggaacttgatgttaattttcttacctctggttagtcactgcattttggaaaagcttctggctgggcgtggtggctcaagcctgtaatcccagcactttgggaggcccaggtgggcggatcacaaggccaggagatcgagatcatcctggctaacacggtgaagccctgtctctactaaaaatacaaaaaaattagccgggcgtggtggcgggcgcctgtagtcccagctacttgggaggctaaggcaggagaatggcgtgaacctgggaggtggagcttgcagtgagccaagatggtgccactgcactccagcctgggcaacagaatgagactctgtctcaaaaaaaagaaaaaaagaaaaagcttctcatatttatggtgtcatttagatgtccttagtaaatgtatatacatatgttctg

SEQ ID NO: 97 - DNA, 1098 bp, Homo sapiens
tgagcttggtgctgtagactaaagcacattccttcatgtcaaatcacttacagtttaacagacgattagacatataactgtcaaaatgagcagtatagatggtaagtgctcagtttaggttattgtgtcatggactttttattcaccttaattttgggtaattgctatgagtggaaatgtagacttttatttttgtctttgaaatagtatcctggcttaggtttttcagaaaggagattaaaattacagttagtgttcagtactaacttatggcttaatcctccaaagaaagagttttttaaaatattttctttatatgggaaaaccagttgtattacattttgttttggcataagtaagatttctgtttgcattttagaataatacttaaaaactgccatgaagaagaaaaaccacttaggtaaattgcttgattttaatgagagagatatagtgctcacttgatacttagtttgctttaattcttgtgtttttgtcaggggtaaaagcatgtctacgaagaaaagtatgtgaacaggaagaaaagtatgaaattcctgaaggtccacgcagaagcaggctcaacagagaacagctggtatttttcttttaatacaactttcattgttcttattatgacatactattattatcaccatcaggaagaacttctgccctttcaacagctacaggtgactgattaaaattttaattgtgcttatttcaagcacttgattctgaaagatgatcacgatgagcagtaaaatccagaaggtaataatttcatactgttaatggatttttggcatcttgaacattgccataaacctttcagaatctgaggtaaatctcagatacaggaagtagcttgaaagaagacttacagctgctgcttggatttagttaccatatgtctctatggccacatattgtagctttaatggataatatcgcattatcctgttgatattatataagtatattagaagtcacaaagaaaatttccatagaagggaattatgaaactttttttatttccaacgagcatacggaagtatgtttcatagctaattggatccctagcctcagcacaaaaat

SEQ ID NO: 98 - DNA, 1458 bp, Homo sapiens
ttagtatgcttgaaatataacttgtcccagcacctcattaagtagcttcttagctgctcataattgttacagatggagcattcctaatccaacatctaaaatgctccaaaatccaaaactttttgagctttgacatgatgccacaagtggaaaattccacacctgacctcatgtgacaggtcacggtcagaacacagtcaaaattttgtttcatgcacaaaattactgaagatattgtataaaattacttcaggctatgtgcataaggtgtacaagaaacaaacgaattttgtgtttaggcttgagcctcatccttaagatacctcatgtatatgcaaattttccaaaacccaaaaaatttatgaatctgaaatgcttctcctccaaatgtttcaggtaagggatattcaacttgtatttttattttcctcattcatatacagtgtttttgaatacagtattttgatctgcctttaacaaatgttttctcattatttcagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggttt

SEQ ID NO: 99 - DNA, 1500 bp, Homo sapiens
tattttgatctgcctttaacaaatgttttctcattatttcagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactct

SEQ ID NO: 100 - DNA, 4528 bp, Homo sapiens
ggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaa

SEQ ID NO: 101 - DNA, 1500 bp, Homo sapiens
agaaattctgatacatgctacaacatagatgctccttgaagacattatgctaagtgaaataagccaatcagaaaagagcaattattgtatgattcaatttatatgcggtacctcgcacttacagacagaaagtgcaatatcggctataaggggttgtgagaaacgggtaacggggagttactgtgtaacaggcagattttctatttgggataatgaaaaagttctggagatggatagtggtgatggtttcacaacaatgtgaatgtacttaatgccagtgaactgtacacttaaaaatggtgaattttatgttagatagattttatcacacacacaaagaggagggagggcgggagggaaggagagagggaaggaagtagagaggggagaagagaggaagaaaggaaagaaagtaagatctggcatcacagggcccacattcccgcgtgtcagcaataggctgaaacagaagcatggtttctcacgtgtccatggaggcatctgagtgtgtgcccactttcccggttcaatgacaatttgcacctgctcgtgtagaggggtacgggtgaaacagagaccagtattattaaggggatggagaggagagaccgccaaaacatcgcagagacacaccgtcggaaccaagagaatggggtgcagacgcctggcttggcctgtgggaactggcaagtctcagctctcaaacgcccgggcttttcaacccgccacagccgggttccagctgcctacttcctttaaagccttcaccgactctaaaacaccaaaaacaaagacccaactagctccggaagcccgagatgtaaccgtagtcatctgaccctcccgtccggactctgattgggctttggagatacgcgtccctcccggcgctgtacggcgaccccgccccagcagcctgagggggcgggaacagatgtccgagtgcgacagtattggtcggcttccccaggaagcagccaatcggaataggcaagcttccggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccat

SEQ ID NO: 102 - DNA, 1093 bp, Homo sapiens
tctgagtgtgtgcccactttcccggttcaatgacaatttgcacctgctcgtgtagaggggtacgggtgaaacagagaccagtattattaaggggatggagaggagagaccgccaaaacatcgcagagacacaccgtcggaaccaagagaatggggtgcagacgcctggcttggcctgtgggaactggcaagtctcagctctcaaacgcccgggcttttcaacccgccacagccgggttccagctgcctacttcctttaaagccttcaccgactctaaaacaccaaaaacaaagacccaactagctccggaagcccgagatgtaaccgtagtcatctgaccctcccgtccggactctgattgggctttggagatacgcgtccctcccggcgctgtacggcgaccccgccccagcagcctgagggggcgggaacagatgtccgagtgcgacagtattggtcggcttccccaggaagcagccaatcggaataggcaagcttccggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccataatcacgagctgggctactcttgtttttgagtgtctactgtgtgccatgttcctggcacccttgatcttacaactgtagctttacgatatccc

SEQ ID NO: 103 - DNA, 1102 bp, Homo sapiens
cttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggactacaggcacctgccaccacgcctggctaatttttttttgtatttt

SEQ ID NO: 104 - DNA, 1701 bp, Homo sapiens
cctgcctcagccttctgactagctagggcttcaggcatacaccactatgcccggctaattttttgtgtttttattagaggtggggtttcaccatgttggccaggctggtctcgaactcctgacctcaagcattccacctgcctcggcctcccaaagtgctgggattacaggcatgagccactgcacccggcctcttccctttttcatttatgctgtcaccccgctctggagatgctattaactaaggactactagcctgagaaataaagtagtgggaatgacctctcaaagccaaataattagcctctgaatgggaaggaccagagaacgaatacaatttaagttacctgataaatttaaaatcgagagagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaacactta

SEQ ID NO: 105 - DNA, 1160 bp, Homo sapiens
tgatgcctctgtttctgaagggaaaatttgttaaaagatagacagcaacaatttgggttgtgttttcccacatagtccaaaagagagacttaaataactgggaaactttgtgttaaagatgatttgtacaagcagccgtgtttgtgttattatcagacttatctgttgcactttacccttatttaaatatgagtgaaaagttaaaaactagaaacgtcaatagcaaatacgtgtttcgtaattaaccagagacagacatgaaaatccctaagcaaatcttcggcctcagtcgagcattcactggacttaatccacttgactcaatagtaatcatttatgaataaataagccagcattagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctcaaaaaaaaaccctgtttatacatttaattggttgcattctaaagatgaagtcccattatgattaattacatgaaacttcaaacaattttaggtagctgatttttttttttttttgagacagtctcgctctgtcacccaggctggagtgaagtggtatgatcttggctcactgcagcctccacctcccgggttcaagtgattcttgtgcctcagcctcccaggtagctggaactacaggtgcacaccaccatgcctggctaattttttgtattttcagtagagacgaggttttgccatgttgcccaggctagtcttgaacccctgagctcaggcaatccgcccgccttggcctcccaaagtgctag

SEQ ID NO: 106 - DNA, 1128 bp, Homo sapiens
tatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatccccaaaataggcaatgcagggcttatatgaagaatgtaagtggtacagtatgactgaagatttgtgttactgaaaggacataatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgtcataaccttgtttactggttagccagcatttgcctgaacaactcatgaactcatgctctcacaagggcgttcattccccattttgaaaatgctacttgttagaaatcatctctcatactgagccaagatctgcaactttaattctaggaggtttttaaatttttatttacaaatgagaacttccacaaaatcctgtgtttcagaaacacggaccacagagcgtaatctcatcataatagagtttccctccccctccttgactaaatattattaggtcttttaactctccttgctagaaattgctttcttgacctttcatcctccggttctcccttgtatatactctgagtctaggtctgggtctt

SEQ ID NO: 107 - DNA, 1133 bp, Homo sapiens
cccaggctggagtgcaatggcacgatctcagctcactgcaacctccacctcccaggttcaagcgattctcctgcctcagcctcccgagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgttt

SEQ ID NO: 108 - DNA, 1662 bp, Homo sapiens
acttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaaatcacaatttcaaaagcaagttgctcttttgtctctatagcagctgtagttttataaaatgtgtaattataacctattgtagtacggctctaaagtcattacaaatgtgatgtgcctttgaattaacattttttagttcctaaaacaaactcatgagggccaagtttttaatgattttgggatgggcaaaagcaaaaatggattcgcatgctaaaaatgtattttagaattctgtactgatgagaatcgattaatacaaagtagagaagcatgttttatgtgttaaaatgttaaaatatagggtagtctataaaggatatgaagtcaggagtgtcttaaatcagtcaaactacttctttg

SEQ ID NO: 109 - DNA, 1192 bp, Homo sapiens
tgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcat

SEQ ID NO: 110 - DNA, 1119 bp, Homo sapiens
cctaggccgggcgcagtggcttgtgcctataatcccagcactttgggaggctgaggcaggtggattacctgaggtcaggagttcaagaccagcctggccaatgtctctactaaaaatacaaaaattagcaggatgtggtggtgcatgcctatagtcctagctactggggagggtaaggcatgacaattgcttgaacctgggaggtggagattgtagtgagctcagatggcaccactgcactccagcctgggcaacagaatgagactctgtctcaaagacaaaaacaaaaacaaaaaaaacactttttttttaaagatcatttttacacattatttaaattgcctaaatataatagtttgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtctgaaaatttgatacagataacctctagttcaatctgtttttattctacaagaatgtatcttagtaagaacttttaaccaatgctattttttgctgatgtaaatttttttaacgaatagaaaatcatttcttttttcagtactgccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaaga

SEQ ID NO: 111 - DNA, 1114 bp, Homo sapiens
tgtgttatgcttttttttgttttgttttgttttgttttaagacagtcttgttctgttgcccaggctggagtgcggtggtgcaaccttggctcactgcaacctctgcctcccaagctccagcaattttcctgccttagcctcctgagtagctggaattacaggcacctgccaccacgccaggctaatttttgtattttcagtagagatggggtttctccgtgttggccatgctagtcttgaactcctgaccccaagtgatccacctgcctcagcctcccaaaatgctgaaattacaggcgtgagccaccacgccctgcctgagttatgcttaataagggttttttaaaatgtatgtacttacatacttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttactataattgctttgtattctctctctgcatatattttcctgacacatttgattgaaaattgcagacatggtatccttttaagccctaagtacttcactgtacatttcctaaaaacaacgtattctctcatataacctcagtacaatgatcaaaattaggagatgtacattgatgcagtactattacttaatctgtaaaccttattctggtttcactagttgtcccaataatgtcctttatagcaaaagaaaatcccagatcatgcatgcattccgttgtgcttctctgtaatcttgtaaacagtttctctctcttaatatctttcgtgattttgaagtttttgaaggccagtcgttt

SEQ ID NO: 112 - DNA, 1099 bp, Homo sapiens
acattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagcta

SEQ ID NO: 113 - DNA, 1149 bp, Homo sapiens
ctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagctaaatcagaacgtttggggctgagagccagtatttttttaaaaatccccaagtgattacaatgtgcagcagagtttgggaaccagagtcctagggcttttcttcacttactgaaattaaaactccttttcagtacctactttagaagtagggataaattgcatgccatatctatcatccctggtatagtcccagtaataaattaatttttacttatctaattttggcttccatatatcctagagtatacttcttgaaatgaaagatgaccctgctttgtcatttccccctaaggtcccagttgaatccaggatgttgaaaatagtccagatactatgtcgaatagcttttttacttt

SEQ ID NO: 114 - DNA, 1107 bp, Homo sapiens
aggttgtagtgagccaagattgtgccactgcactccagcctgggcgacagagtgagactctgtctcaaaaaaaaacaaaacaaaacaaaacaaaaactacttgatattagcttgggctgctatgacagaatactgtagactgggtggcttaaacaacagaaatttatttctcttggttctgaaagccaggaagtccaagatcaagatgctggcagatcccaagtcagatgaagtccctcttcctggtttgcaagtggtagtattctctttgcatactgacatatgcgggtggggagagccagcaaggtctctacttatttttgagcacttatctcattcataactccacccctcatgacctaattatctcccggaggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagactattgcaactctctcaattctggaaattataaaatctcatttggtttaataacaataaattctaacaaaaatatattaaatactccctcctacacacgtatattataacttttggtttcaatgtctttcctcaggcttctatcagtgtttgaattatacagctttttgttttagtgccttgtcccaagcctgtctgcctttgcattatgttaactaaaatgagattctgaaattcatagtagttttccatgtaaccccctttccacttttccatggagaatatttttggtatttctattttattttttagaaattagtatacatatttgtgtggacaaatcagtcagtagagatctaccaagaaa

SEQ ID NO: 115 - DNA, 1161 bp, Homo sapiens
ctcctgggttaaagtgattctcctgcctcagcctcctgactagctgggattacaggtgcccaccaccacacctggctgattttttttgtatttttagtgaagatagcttttcaccatgatgtccaggctggtctcgaactcccgacctcaaatgatctgccctccttggcctcccaaagtgctgggattacaggcatgagccaccgcgcccggccaaggatggcttttttatacccacatgtatctagtgtgaagtagagcccagagttcatccaggtccacctcacgagtcattagcagcgacaggattaaaagccacatctcatttccagcacacatgaattccttgcttgaattattcacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttctttgagacttctaaagttgctttttctttcataaaaaaaatctgcttgagatataattcacatatcataaaatttatcctttcaaagcaaacaagttagtactttttagtttatttgcaaagttgtacaataatcatctctatctaattccagaatttttgatcaccataaaaagaaacctcatacccagtcacttcccccaccccctaatgcctggaaaccacaaatctactaactactgctaacctgtttctagagtttattactctgtacattgcatgtaaatagaatcatacagtatgtggtctttgtgacttttcttttttttttttttttccggagacagagtctcactctgt

SEQ ID NO: 116 - DNA, 1196 bp, Homo sapiens
gatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtat

SEQ ID NO: 117 - DNA, 1191 bp, Homo sapiens
aataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttga

SEQ ID NO: 118 - DNA, 1148 bp, Homo sapiens
aaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtgaaaccctgtctctactaaaaatacaaaaaattag

SEQ ID NO: 119 - DNA, 1200 bp, Homo sapiens
ggtgtgatggcctgcacctgttatctcagctagtcaggaggctgaggcaggaggatcacttgagcccaggagtttgaggctgcagtgaaccatgattgcaccactgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgtta

SEQ ID NO: 120 - DNA, 1193 bp, Homo sapiens
gcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcacagattaataggccgaaagttaatcttgctagggaactccttaagtgataaatatatctcagtggtttgtttctttttggggtttgttttgagacggggtctcgctgtgtcacccgggctggagtgctgtggcatgatcatgactcactgcagcctcaacctcctgggctcaagtgatcttcccacctcaatttcccaagtagctgggactacaggtacacaccagcatgcccagctaatttttgtattttttcgtagagacagagtttcaccatgttgcccagtctggtctcgaactcttggcttcaagcaatcctcctgccttagcctgccagagtgctgggattacagataagcatgagccactgagcctggcctcagttgttttaattatttttatttaatctctggattaaaatctcagagaaacaattgaaacttattctttttttgtttgtttttgagacg

SEQ ID NO: 121 - DNA, 1123 bp, Homo sapiens
cacatggggaaagagtggaggaagaaaagtttgtgctggaggaagtaacaatttggttatgccgtctagggtggggtgtacaagtctggagtgcagagaagaggctggagctggaaatagaaatgcagcgttctcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatggtgggttcctgccctctgtgcctgtctgctgcctctgaggtgctaactttgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacctcgtcacactgacatccaagtcagcccccagtggtgtgccagtcacctctgagaggacactagtgcttatgccccctgtgagtgccagttctgaacttactcataggatccaaaaggggacctttgggcccaggggttgctggttcccgtaatgcaagtgctcaagggatcagagccctgggtaccagttccagatctgccaccacgtcatgctgtgtggtctctagcaggccaccaatagcctctttgtgaatcaggttcctccaccaaggaaggaacatgttatctgacaaacatgtctaaagataaaatttaagactagtgtttaaatgttttggagaaatgagcatgcagctagaatgttattattgttagtcattgatagaacctgcctgagtg

SEQ ID NO: 122 - DNA, 1202 bp, Homo sapiens
agtaaaataggatctagaattttcttatgttcatttactaagaaactattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaatattgctaatggaatgacagttgttaatggagtgacaattaaggtttgatccaaaacaaaaatatttgcttcaagaaacaacaaaaaatatttgcttcagatgtttaaaacatctactgactaatagttatgactaaagttttctttctttttttaatttgaggacaaagtctgactctgttgcccaggctagagtgcagtggcacaatctcggctcactgcaacctctgcctcctgtactcaagtgatcctcccacctcagcctcctgagtagctgggactccaggtgtataccatcactcctggctaatttttgtattttttgtacagatggagtttccccatgttgcccaggctggtctcaaactcctgagctcaagtgatcagcccac

SEQ ID NO: 123 - DNA, 1355 bp, Homo sapiens
ttgccactcctggccacccagctccaccccatgcatgctcaccccacagctgccttgctctggactgtgcaagtccagtcattccggggtgcctgtcagcagggagctggggccttacagcaaggtgtttcacttcttttatttggtcagaatagatgaggacatgtggacctcagctcctcttgcaggctctggttgtaggctgccgaaggtgtgggtggagagaggggcggtgggttggtcacaagtcagaaaattaagaaacagtcctgcacatttcagaaagacaaatccagaacaaatttatatgaagggccgcggtcctttattccataagtagtaaaggaaacttaccttacctagggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcc

SEQ ID NO: 124 - DNA, 1500 bp, Homo sapiens
ttacctagggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcctgtagtcccagctactcaggaggctgaggcaagagaatcgcttgaacccaggaggcggaggttgcagtgagccgagatcgtgccactgcactccagcctgggtgacagagcaagactccgtctcaaaaaaaaaaaaaaaaaaagaaatatacatgctctgcaaatatgtgaaaaaggtcaatctccatgaataaaaatatgataaaaccatgtgagaccattcttttgcctacaaattatcaacactggataatatcccagtatttggggtcagcgagaaagattggcagattgtttgggtggacgtgtgtggcagttgctgtagtcctttggtattgtggtggcctcgtttttcaggatgctccataatgggccaattggccccagcatctttggtaggattttggcctctcttgcctgaactccagtggccccattttcggagacatgcgtttctcagctgtaggtcacctttgtctgggtgccacacagcgaggaag

SEQ ID NO: 125 - DNA, 3616 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttataga

SEQ ID NO: 126 - DNA, 1500 bp, Homo sapiens
tggtgacaattatttgcattttccaaatggacggaatgagcctccggagggtacacgaggtcaccagcgtgagcccgcggtggagctggaggcgtatttatagctggctgacctcagtcctgttgggccctcgccgctccttatcttatgccgctggaattcgcgggctcgcaggtcacaggagcccgggcgcgccgggcctggcgctcccgaatcgatgagggaagccgctctccccggcagatcctcccggccggggagcctccatcaccctgcctgcgcctcggcacgctggcaaggagcccgggaagagacgccgggagcggtgggtgggcgagaaacaaatgcaatgtgacttatatttttctttgtcgcaactaccacgacctggccatcccccaccttggtgacttggtgccttcccagcgaccttatttcacgccagctgactggcgttcaccgcagtgtgagtgtcggccggaggaggggtccacgcgaaagagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctct

SEQ ID NO: 127 - DNA, 1281 bp, Homo sapiens
gagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacct

SEQ ID NO: 128 - DNA, 1115 bp, Homo sapiens
accagtgcaattaattcttcaacctcacaagtcctaatgttctaggtagaagtgtggctgaaattaaaactggttattagactttgtaatacaaaagtagaaaaaagtgatattagctaggtggtccaatatatttttgtctaagtaggaatctgaatattgtagaattgtacatttcggtgctgcttctagctattcctgttcttttttttttttcaaattgagatgagttttttttttttccatcaaagcttaagataacataggaattttatatggaagtactgttcccacagaactaactttacaaatgtaaagcttgggcagaggttgaggaaaatggtaaagtgatagatttcgtaaaaactgtagaaattttcattgactttactttgaaaatgtatagttgtacatgcgaaacgcttctagtattgcttctagatgtattattctgacaaagttccctaagtcttaaataagttctttttttttctaaacagacttatgaaaatatgcatcagtttaatactgtcttggaattcatgagatggaagcataggtcaaagctgtttggagaaaatcagaagtacagttttatctagccacatcttggaggtaaggaaaagaacataatttagaataatatgaaatttctcattttttaatagttgaaaataatccttctacactgcaactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggaggctgaggcaggtgggtcacatgaggccaggagttcgagaccagcctggccaacatggcgaaatctcgtctctactaaaaatgcagaaattagctgagcatgatggcctaagcctgtgatcccag

SEQ ID NO: 129 - DNA, 1219 bp, Homo sapiens
tgtctcaaataaaataaaataaaatgaattaatatgtgtaattttctaggtcggcttcctcttctatctatagaataaattatttattagaaagacttagggtgttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctattaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagacc

SEQ ID NO: 130 - DNA, 1163 bp, Homo sapiens
tgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagagttaggagaatagagttgcatttagtgctattttaagaattattaaacttgtctgcggtttttttttcattcatatatagtatctttccagaaagccaaaaagccttttgttttgtatattagaacattattccattaaatgattgataggtgagttactatattagaattatgttataatgcagcttttaaaataagatcaaagggatctagtatttaacatctgagtttttaatgatcttttaatcttaaatttattgatgctcattttagaaaacttagaggttaccaaaaaagaaatcagaaaactcactgacaacctcctacttctttttaatttaaaaaaaaattttttttttaactatagacaggatcttgctatgttgcccaggctggtctcaaactcctgggctcaagcagtccttccacctcagcctcccaaagtgctgggattactagggtgagctgcca

SEQ ID NO: 131 - DNA, 1103 bp, Homo sapiens
cccatcatattcagtaaaaggtgccttttagtccccttttttttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctg

SEQ ID NO: 132 - DNA, 1097 bp, Homo sapiens
agaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgtttt

SEQ ID NO: 133 - DNA, 1100 bp, Homo sapiens
ttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaa

SEQ ID NO: 134 - DNA, 1145 bp, Homo sapiens
attctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataa

SEQ ID NO: 135 - DNA, 1193 bp, Homo sapiens
gccagccacttgaataacctgtttatgatttcagaatacattgtacattgtttcatactttaaagtacattatggccgggcatggtggctcacgcctgtaatcccagcattatgggaggccgggggtggggtggatcacctgaggtcaggagttcaagaccagcctggtcaacgtggctaaaccccatctctactaaaaatacaaaaaaattagctgggcatggtggcgggtgtctgtaatcccagctacttgggaggctgaggcaggagaatcacttgaatctaaaaggtgaaggttgcagtgagccgagatcgcgccactgcactccatcctgggtgacagagcgagactccatctcaaaaaaaaaaaagtacattataagtttttaactggagttggttgggtacaccatgctttttgatgagatggactacccctttgccagtcttaatgggtttctttcatcaagagctcaaaccttttacttttttctataaaggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtgggtacacactgattcagtcaatttcatttttgacaaggctagtgaggtacaggtggaagcctccatatgtgctttgaaaatgtgtgagttcaactatatacatttggctaaaggaaacctagtagaatacacggtttgaataaaacatagtccggaatgccaaccaagatctttctttactaaccagctgaagaaacagcagtgagtttcaaatggaaaataatactagtttattggacttactcccatagtaatgaaaacccagtcttttatagataacttaagcagtgatttagggtaacattaacatatgtgccttttccctttcataagctcaacagcccaacatgcagtttcattgtacgttctgtgtttaatgtgtgtttccccccatctccacatttacacaatagcaaagtaatttaggtgtgagctggtcagtcaggtacataagccgatctggctatcctgagttttcttttcccttcacctcttgt

SEQ ID NO: 136 - DNA, 1298 bp, Homo sapiens
ggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagatatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacaggtgagtggttctttgccccactgttttgaaattattttaatttccaaaagatatttccctatttgtattcaagataatggaattctaaaaatgtgcatatgcttgtttttagttacataaatgtatagttgggggggattttgttctttttacaaaaattgtgtcctacttctcctatacataattcttgatatatatatatttttttggtgtttttttttgtttgttttttgttttttgttttttgttttttttaaagacagtgtctcactcagttgcccaggctggaatatagtagtgtgatcttagctcactgcaacctcgacctcatgggctcaagcaatcctcccacctcagcctcctgagtagctgggactacaggcatgcactgccacacctagctaatgtttttattttttgcggagatggggtctcactgtgttgcctaggctggtctcaaactcctaggctcagctgatcctcccaaagtgctgggatta

SEQ ID NO: 137 - DNA, 1176 bp, Homo sapiens
taacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgtgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggaggtgggagtttgagtagtttctgattatgttgatttactcatcattttaaaaataacagctccagttatataactttttagtttttaatttttgtgggcacatagtaggtgtatatattattggataaggagttattttgatacaggcatgccatgtgtaataatcacatcttggagaattggatatctgtcccttcagacatttatcctttgtttcaccaaccagttatactccttgagttatttttaagtgtacaattaaattattactaactgtagtcctccccgttgtgctataaaataccaaatacttattcattcttctattttgtctctacttattaaacatccccccccatctgctgctacccttcccaacctctggtaaccatccttctgttctccatgagttcagttgttttgatttttagatctcacaagtaagtgagaacatgtgaagtttgtctttctgtgcctggcttattttacttaacgttatga

SEQ ID NO: 138 - DNA, 1131 bp, Homo sapiens
tccatgtagggaactgtttaccatttgtgtacccgggcactggccaaggccaaaccttgcaagccgcctttcctaagggaaggtctcaggcctgctgtgtgaacccttatctgcacctcataagtctttctactgcagagcaaaatgaaacaaaataataaaaactattcattagtaggaacaaccatataagtaaataattatactttagggtaaatggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgatt

SEQ ID NO: 139 - DNA, 2595 bp, Homo sapiens
ggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgac

SEQ ID NO: 140 - DNA, 1500 bp, Homo sapiens
taaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgacttgataccataatctttaaaatcatttgtcatctttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacctgcctcggcctcccaaagttcatttgtcatcttaataaaaatataaagacaggcaaagtttattggaaatgttcaaatggtgtgtggaagcaaaaaattacagccagtatatgagaccactattatggttttttaaaattaacttggtctagtaaaagtgatatcaagagttaatcttagaaacttgctcagtaaaaacattttctagtataacat

SEQ ID NO: 141 - DNA, 2949 bp, Homo sapiens
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaaaa

SEQ ID NO: 142 - DNA, 1500 bp, Homo sapiens
gtaattgggcttctcaaagataattgacctcttctctcccaattgttttcatgcgtattttgcagagaatgcttggaatattctgttcatgaaaggcacaaagtacataaaatattttgagtgattttcttcaaaataaaaatgattagttttgatgcttcagatgtctagaatgctatgtgccttgtacaggccctacggcatggaaagtgctcaactgatatttgttaaatgaatgaatctggaaaacgaaaaatacacgaaatattttattcctcaacaatgaagaaaaagctttcagacttccatttagactcgttttaactggctgaattcttcaatgaaaagaaaacacgcgtcgcactgctaatttagctgttcctaaatatatttccatcaaattctgcttggctgtttcaaccttggggttgaagttcttattttgatgacacagagacgttcattgcagtggaaatagcaagtagtattggcttccccgccttcctccctctaggatttcaacttctcctcctcgaacaccagccctgctcttctagtaaatcccacattacagaacaggctgaggacggaggagacaagaggaaagtaggaaaccggagccatggaaacggcggagcggaggcaaagtgtgagagcgcgggtggttagaagggaaaaaaccctccccggacgacggcgcgaaggcgcgcctcagattacgtcacgcaccggggtgacgtcacgaccgtgacacgcgggtgacgccgttgccgcggcgacttctcgtcgtctccgcccccttcccccgctcccccccgcacccccgcctagcgtccttcccccaatcccctcaggctcggctgcgcccggggccgcgggccggtacctgaggtggcccaggcgccctccgcccgcggcgccgcccgggccgctcctccccgcgccccccgcgccccccgctcctccgcctccgcctccgcctccgcctcccccagctctccgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgagtgctggcgccaccctgccgccctcccgactccgggctcggcggctggctggtgtttattttggaaagaggcggcggtgggggcttgatgccctcagccaccttctcgggccagctccgcgggctgggaggtgggcatcgcccccgtgtccctctccgtcatgcagcgccttcctacgtaaacacacacaatggcccggggggtttccctggcccccaccccagatgtggggattggggcagcggtggttgagcgggaggctatcaatagggggcgaaactcagggttggtccgaga

SEQ ID NO: 143 - DNA, 1199 bp, Homo sapiens
cttcctccctctaggatttcaacttctcctcctcgaacaccagccctgctcttctagtaaatcccacattacagaacaggctgaggacggaggagacaagaggaaagtaggaaaccggagccatggaaacggcggagcggaggcaaagtgtgagagcgcgggtggttagaagggaaaaaaccctccccggacgacggcgcgaaggcgcgcctcagattacgtcacgcaccggggtgacgtcacgaccgtgacacgcgggtgacgccgttgccgcggcgacttctcgtcgtctccgcccccttcccccgctcccccccgcacccccgcctagcgtccttcccccaatcccctcaggctcggctgcgcccggggccgcgggccggtacctgaggtggcccaggcgccctccgcccgcggcgccgcccgggccgctcctccccgcgccccccgcgccccccgctcctccgcctccgcctccgcctccgcctcccccagctctccgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgagtgctggcgccaccctgccgccctcccgactccgggctcggcggctggctggtgtttattttggaaagaggcggcggtgggggcttgatgccctcagccaccttctcgggccagctccgcgggctgggaggtgggcatcgcccccgtgtccctctccgtcatgcagcgccttcctacgtaaacacacacaatggcccggggggtttccctggcccccaccccagatgtggggattggggcagcggtggttgagcgggaggctatcaatagggggcgaaactcagggttggtccgagaaggtcacgattggctgaagtatccagctctgcatctctgtggggtgggggcggcggcggcctcgacgtggaggatataggttagttgctggggctgagacaacagcccgagttactgtcgcgtgtaattcttacatggtcgtggggatgatggggctcatcatttcctctctcctctcccggactgccccccttctcag

SEQ ID NO: 144 - DNA, 1102 bp, Homo sapiens
tataaccattagggagtaaaatatatgcatattgacgtggagagacttctgagacattactccatgaaaaaagcaagtgttaaaagtattttatatatagtatttaattatatgtgtacatttcatatatgtatgtcttaatgttttttccatgagtaaaagggagacatggaaggctgctcaccaaaccataaacagaacttaacctttttgaaagggggcctgggaatgtgaggaagatgaagagagatttcatggtttattctgaatattcatgtattctttgaatcttttatagttgagaatacgttgtattactagtgtagaaaaaaatttaaagatgtttcataataaaagagaaaaaccactgtactaaatgatctctaagctcaaaatttgaggaacactggcagttactgtgatgtagttgtctatgttaaaatatttctaattcatatactaagtgatttttatttaaattcttttgaaatattttttaggtgtggaatatcaaacaaatgattaagttgacacaggaacatatagaggccctattggacaaatttggtggggagcataatccaccatcaatatatctggaggtaagcttttgagtatcatatctagtaattttgaaaagaaaaaaaatgaacttataaaaacatttgtactgataatcttgattattttaggaggtgggattaggaatagatttgggaagagagaattagctttgcctgtattatacttcttaatcttgttttgtgtcacttgttaaaataaacatgtattttataatttagaaaacatcagaactaagggggaagtgatataaatttcaaggtattactctgaattaaatttttatttttatttttattttatttatttatttttttttgagacggagtctcgctctgtcgcccaggctggagtgcagtgacacaatctcagctcactacaacctccgcctcccagcttcagacgattgtcctgcctcagcctcctgagcagctgggactacaggcgcacattaccacgtccacctaattttttctatttttagtagagatggggtttcaccatattggccaggctggtc

SEQ ID NO: 145 - DNA, 1264 bp, Homo sapiens
taaattttggggtttttttggacaaatccttaatacctcatgtccttttcaacttctttttctgttgagagagagagagaacgaatggaattcatatgcctacaacttttccgggacaaaataattcttttaatgggaggaacacttttccttgatacagtgttttatcttacgttagacatgatttggaaggtaaatataagtggaccagaaaattggaaatactgtgcttttttattattcatggaccatctagatatcacatatgtataggtcaaatttatcaggtgtaatatagtgtagtgtctaataacaaagaatttatcaatttaaaggtgaaagtattcatttatagtatttctggcacttattttgtaatttgaaacttaaaaccctatcaactggtgaaaagattataatcaaaggctaaaattttatattctcttttgttaatgtcaggacaaagtccggattgaatataagtctgctttattttataggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtgagtcagttttaatatcaccattttgctgtttctttgtatttttcagacagatcagttgttgaaaattaatatattattacttcatactcagaggtcatgcaaatagaggcatccatgtcatacaggaatgaaaaatatgtaattatttggtggcaaagtctatattccttaactgaaataaatggtattgtctctagtgttggatttgacatttaaacctgtctgccaaacttgaaccacagtcatgtctaagcactagtttaaaataaatcaggattttaagacttgagcttgttcattatctaatgtgtgtcaggtaagactcattcttcacccttgagaaatctcctttctgagttatattatcagatgttgaacgttcagtgtgattgatatgtttcccctcatctacttcatttttggttgttgaatattagtattaaccattggaacagcgtaccctgtaagtaacatttgaagcatttaaagagaaatct

SEQ ID NO: 146 - DNA, 1104 bp, Homo sapiens
aaacaggggcaccaaacaacaaatatcaagtatacatgttaagacaggtttttttcttcccgctatgtttagggccagtaagaggtctcttaaggacagtcagtgtgattgaagggttatacagttttcagctttgaacagtattggatcaaaattgattttgcttttaatattgacatctattattgctcagtgatggatatactgcgttggtgggtatattgtagcagatactgttacttcttctttttatatgtttaaagtatttcataattttaataaaatagaaaattaactttgctttgatttaagttggtgaataataacaaatatttgggttataatttccctttagtattaagttagctgtagaaatggtgttgtatctgacctagtaacccatttgactttttaaagatgaattactaaatttttttaatgatatgaaaaaatgtaatttgctccctttacctcttatcaatatatttatgataccataggtacctgcaaggtgtggagttacagtccgagacagtctaaagaaagcactgatgatgagaggtctaatcccagagtgctgtgctgtttacagaattcaggatgggtatggtttgtatgtgacgtgaaattttgtttaaaaagaaaatcacacattaaactttgaagttttcttaggatctttaccaaaacctagggaattgaaagtgtactttaggaaaaagtattaaaataatactaagttagcctgaagaaatactgtaggccatatgaggagttaaataattgtatatgactgtagggtttgttactttgatcaaatgattttatttggaatttgagattcttacaatttttgaaccattcagagtgtgatttatttggataatagactcttacccccctcccatttttaatacaaactcatagtttcacaaaaggtatatcaaaattaacattttatattgacctacttttctttcagaaagtgtctaacattgttccaagaccctcacattttgaatcctctttaaaaaaaaaaaaattattttgggggcatgttgtccctgtcccttgagtactctttttccttgaatggatagataa

SEQ ID NO: 147 - DNA, 1103 bp, Homo sapiens
aaaaggtatatcaaaattaacattttatattgacctacttttctttcagaaagtgtctaacattgttccaagaccctcacattttgaatcctctttaaaaaaaaaaaaattattttgggggcatgttgtccctgtcccttgagtactctttttccttgaatggatagataagtccgtacctgtgattttttttttttttttttttttttttggaccccaggaacaatccattttctgctgttgtaggtcttttctggagctgacttgaagaaaagagtacatctctttaccctgctgtttgtccaagagtgatacatttatttggggtaaacttaaaattaatttattgccatttaaatttctaacgatggaatattagggagccaaacctccctcactgttactagcccctcgataaccaattttcatatcttcagcatgaggtatatgaatatttttaggtgtaataaccaagaaaggcttgtgtctacatttttcagagagaagaaaccaattggttgggacactgatatttcctggcttactggagaagaattgcatgtggaagtgttggagaatgttccacttacaacacacaactttgtatgtatctttacatttttttttgaaatgtcaaaaatgtttagattttaatgaatgaatttttatttagggaatgtgaaatatggatgagtaattttggaactgacattttacctgagttgaaatcagttgttttctttaaaaacttgtatttaaacaagagtttaattttaatctttatactttctttttaatttaaaaaagtaaaatgtatgcattgttaaaagataattttgaatagtgcagaagtatgtcaagtaaaaaaagtgaaaataccctcctagaggccaacatttgtttagattaacagattattgttctgtcttccaaacttttttctgtgtacacaaacgtgtgcttgtacctgtaagcctaaagttttttcctttctttttttctctctttccttcattactttcttttcttttccctttcttaaatcaaagtagagccatgctatgtgatattctttgccttatttttttttaattcaacaggat

SEQ ID NO: 148 - DNA, 1149 bp, Homo sapiens
tagctcatttatagttcttcctctccctcctctcccccaatatttttattagtagttttttggttcttctattgggtgcctttgtaactttaatatatgcctttcttgttccgtcaacaccagtcggcatttcttaacctcccttctttgtatgataattaaagtataggcttcttcctttcacctctgtttcctcctccttttcatgtctacttttacttttatgttgtcaagcttgaaatcagttgccagccttttactcatttctcattttttaacttctgggtttttaagttagatagtggggtgggaaataaatatgtgtagtccatctattatcttgaacccccggttttcattttataatagtactttagtatgtgagtttcatgatataaatatattacaactttgttattttaaacaagagagtagatacgtcagtttctagaaagttttcttgtgagtttttgaaatctctgtgattttttactttgcaggtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgagtaagtaatccaaaaatatctcttttctacctaccattttacacttaaattttcttaatgtgaagctacgatgtctaaaagtctgtgagggtttttcttccatacgattgttatagagaattttttttaagtgtagttagagaataatatgtggaatggacagtatttctctcccaaattgtaatgctggttcagctatacagttaatttatattttatattatcgtttaattaatcaagacccctaacccatagaaaccatttttggatagtttctaggaggagagggagagttgtttcaattaaattaagcattatgattttgtaccacagatcaggtagtctgattctgttagctattttgtaaattacgtttatattcttcctctctctccttcatccccattcagctcccttcccccaatttatttgagtaagatgtaaaatttttgtatccagtatatatctctttctaaaatttctctttgctgtatgccagt

SEQ ID NO: 149 - DNA, 1120 bp, Homo sapiens
tgagtaagatgtaaaatttttgtatccagtatatatctctttctaaaatttctctttgctgtatgccagtttttctaatagattagactgagtctattatctctttttgtgtcattggtgctgctgctgttaaagtcttacttttcttgatcacctgagcaaataaaacttaactctgtactttaagtaaattataatgtcacctaatttacagtagatactttttattctcattctttaaccataaagcatgattttcatcttgtagtatgtagaaatttgctgaactgaatgattagttttaagttataagcatgcctttgaaagtgcaatacaattttttttaaaataagcctttagacaaaaatacaactaattgaattttaacagttgtttctgagaatggaatttgatctcagtttttttggttaactatgtattttggtatatgaagcttctgggttttgcacaagttaggtttgttttgttttgcctcacagtttgctgtttgtctccaagttctttgaacaccacccaataccacaggaagaggcgtccttagcagagactgccctaacatctggatcatccccttccgcacccgcctcggactctattgggtatggtttgacttctgctcttgggcgacatgctacttgaaccgctttcttttggatctcctggttaattagaaacctttccaatgtttaaattgttaaattaaggactttttccccaaataacttatcataccactcagatatttacatgcatttgatacaaataaatgggattaaagctgacatagactatttcagaatcagtcctgaaaaaatcaatattgggtatgatttgacttctgctcttcagtgacatgcttcttgaactgctttcttttggatctcctggttaattagaaacatttccaacatttaaatgcttaaattaaggatcttttccccaaataacttattttatcacaccagtcagatatttacttgcatttggtacaaataagtgggattaaagctgacatagactatttcagaaccagtcctgaaaaaatcatgcaacagatcattttgagtctacaccttgagttcatcttttattaggtata

SEQ ID NO: 150 - DNA, 1160 bp, Homo sapiens
gattttcattcaactcctgtaaaggaacaagtacatcattcaggtcctgaaatatgcatttgtattctcaaaatatttataatttcttaatatgtaaaattttcattttagtaaattcagatgtcaagacaatgttagaaaaaaatggcaaattatattcagtcattctcagagcatttttatataacttcaaaggttgaacttcttcagttgatggccacaggtaatttctagccataagtaaatttccctagtgttttccaggtaagaatcagtggtcttatcattgatagttcctggagggcctacttgagcaaagcagctttggcagtattggatttttaaattaatacttttaaaagtcattactgctaggtttttaatgctttaatgattttgagaatataaaaacaagaaaatccttttatcttcctttttaaatattattacctttatatcgttactctgaatcttatcttccaatgacttcatttttccaggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgtaagtatccagcattgctagaactaaaaaaaaaccaagtatgtatctttatttttctgctataattataacttagatcagaaataagtgccatttttcatttatcacagttattttaagtgataagcttcttgtgaatcacaaatcagaaaagcttctggtttctctctgatgacattaaatatttcactgactccaggttatacagtcactctgatttttttcccttatgataccatctctataaaagtcatcttcaaatgaaaatggtttaaatatcaaaggactgatagaagcccttgacagaattaagttctttaaaacttttataaaaatgattatgattgtgctataagaggtggatatgaaattaagaatttcaggccaggcatagtggctcatgcctgtaatcccaacactttgggaggccaagatgggtggaacgcttgacccagaagttagagaccagcctaggcaacatagtgagaccccatctctac

SEQ ID NO: 151 - DNA, 1037 bp, Homo sapiens
cacagcggtttgccacacagattatcccattacctcggtatgaagcacagcatccattagttattctttctgttgctcttcctccttttaccatccaccctccaacaggccccagtatgtgttgtttcccccatgtgtccacttgttcttatcattcagctcccacttataagtgagaaaacacagtatttggttttctgctcctgcattagattgttgaggataatggaagccattggttttgaatggcctgaaatggacatcaacatttgattaggactaataattgtttcattataggtttacattggcaagtgcttcaaaatttagattgtattatgttcactagataattccaaattgttttgtgtaatagttataagatgtattgttttaattaataaaataattcttttaacgttagtggaaaattcagtgttatcgctactctctgattatatgcttgcttggaataaatatacattactatttatttgtaggacttgattagagaccaaggatttcgtggtgatggaggtaagtagtgatttcaggtttttttaaaaactcaaggaaactgcaattgctttgctgcttatttcctttatacttgcctctttcaagtaacagacacagagaaaaatgtgtagagaaacccaaaatttttttgtttttctgtagtgtttgtcatttacctctaataaaatgttaactagtttataacatgagtagaaaagatgactggacataaaaggaagtcttttttttttttttttttttttttgagacggagtctcgctctgtcgcccaggttggagtgcagtggcgcgatctcggctcactgcaagctccgcctcccgggttcacgccattctcctgcctcagcctcccgagtagctgggactacaggcgcctgctaccacgcccggctaattttttgtatttttagtagagacggggtttcaccgtgttagccaggatggtctcgatctcctgacctcgtgatccgcccgcctcggcctcccaaagtgctggga

SEQ ID NO: 152 - DNA, 1137 bp, Homo sapiens
aataagtcagatattttcaacattatggccattattagaaaatgtttccatctggggatttccttttttttaatattgattggctgttgaggtaatattaaataattaattaaaaatgtatttgttatataggcttttacatttattttgctttttgatttttttcatcaaagaaacagaaacttgggagtatttttagtatttctgtcttgttttagagagattgtttttctcctagattttgcaccagtaaataaagtatgtgtctatgtctatcatcagatatcttaaaggtcattaaattggccagaaaactaaaagaaattatagttgtaatcaccaaatgaggcccctttttggcccatcctttccaaaaggtctatatttaaacatgcactacattttaaaattaagtctaaatatcccccaaccttctacccctgataaattaacatacttgctcctccttaatgtatacatttttcttttcactaatttaggatcaaccacaggtttgtctgctaccccccctgcctcattacctggctcactaactaacgtgaaagccttacagaaatctccaggacctcagcgagaaaggaagtcatcttcatcctcagaagacaggaatcgaatggtaagagtatatgatatctttttttctctgaattctttcttcttagaagtcacagccaaatgtaatattatcctttagatatattatgtccatatgtgacacagaattcccataattaaataaatttaagaactgatagttttttgcttaaagcatatttctacggcactgctttttgctgtcatctataatataatttagtaaaaggcagttttggaagagtaacagtattctgttctaaagtaaggaaaaagagagaaagctaatattagaaggcacgaaaaggctggtccagaattcagatatttcagatatctactgaaggacattcttccctatttaaaaaatcaactttcttctgcaaaatgaatccaccatggcacatgtatacgtatgtaacaaacctgcacattctgcacatgtatcccagaacttaaagtaaaatttaaaaataaaaaacgaatactgtttagccgtagtattgctactaattgttgaat

SEQ ID NO: 153 - DNA, 1118 bp, Homo sapiens
tctgagcaaagtatcacaaggacagaaaaccaaacaccacatgttctcactcataggtgggaattgaacagtgagaacacttggacacagggcagggaacatcacacactgggacctgtcatggggtagggggaggggagagggacagcattaagagaaatacctaatgtaaatgacaagttaatgggtgcagcacaccaacatggcacatgtatacataagtaacaaacctgcaagttgtgcacatgtaccctagaacttaaagtataataaaataaaaaataaaaataaattttttccatcctaatattgacttcagtcttaaatttaagttttgtattttaagagtcatacttttaactactattcttccagagaatttttcttaaggggatctcttcctgtatccctctcaggcataaggtaatgtacttagggtgaaacataaggttttctttttctgtttggcttgacttgacttttttactgtttttatcaagaaaacacttggtagacgggactcgagtgatgattgggagattcctgatgggcagattacagtgggacaaagaattggatctggatcatttggaacagtctacaagggaaagtggcatggtaagtatgtaatgtggtgacattgtgacaagtcataataggatatgtttaacaacttttattttgtaaaaaatatcatcaaaggaaatattcactgttcgcatcaataaactattttgattagtttcaggactcctccaaaagtttctaacaaaaattatgggaaataaaaactgttcacagcagtcgggactcctaccattttattacagtaataatttttaaaggggaattcctccaggttaactagtcctcaaaaggattttattttcttttagagtctttcagctgataattttatttgtattataagtcacaagtaaacatattaaaaatgtacttaatggctgggcgcagtggcttatgcctgtaatcccagcactttgggaagctgaggctggctgatcacgaggtcaggagatcaagaccatactggccaacatggtgaaaccccatctctactaaaaatacaaaaattagctgggtgtggaagcacgtgc

SEQ ID NO: 154 - DNA, 1085 bp, Homo sapiens
cagttttagtcattttcctaattgaaagtatcataagtaatccataaatttgaaaaaaatgttaactactctgataaaaaagttttatagtttcctacttttaagcaaaattccatagggcctggtaattgtagtttcaacattacttgcagtttcagttagtaaataaatattaagcctagtaagtataatttaatattgtcaaataatttggaaaataccatgggtacttaattgattttaccaaatttccatggaacaaacaaggttggctattttttggattgatattttgaaatactagtacaggaatatcattgttagttgaatttttagccttagaaaacaaatggagtttagatagctaaagtataatttatttgtgatttaataatggtatggagttagggctatgataattagtgaaaacacccaagaatgttttatacttttaaattttaaaaattgaaatgacacttggagtaacaattgccttttaggtgatgtggcagtgaaaatgttgaatgtgacagcacctacacctcagcagttacaagccttcaaaaatgaagtaggagtactcaggtgagcttgtgtgaattactcttttccagagaaagaagttatttttattagctcctggttcccagtggtagcaactattagctttacagatttactcaaaatgaataaatttgtagaaacagagtatgtctgagtatatttttgtctttaaccacattcttttaagtagtatgcaatgttatatggtatggctgatagaatacttagtcctagactgaattaatggaagtatagtattctgataatataaagtaatagttctacttatgaaaagaatactctccagttttaagcttatcagaatacatttagaggtggtatttagtcctgggctctggaattttagaaacattgacaaactaggatatgcctagtgaggaccacctaaatagggaagattctagaggtgtaacgggggaaaataatcaacagaactgaggatatttagttcacagaaggctgttatgttcaagagagtgcacagttattccagagtgcgg

SEQ ID NO: 155 - DNA, 1177 bp, Homo sapiens
agaggtgtaacgggggaaaataatcaacagaactgaggatatttagttcacagaaggctgttatgttcaagagagtgcacagttattccagagtgcggaaaaaaaagttattccagagagcagaccagggaagcaagccagaggtgaaagttgtaagaaaatgattttgtctcaacacttggaaactttataataccagaaccacttaaataaagatatgagagtcagctacaactgagtgatgaacttcccatagttgaaggtatttaagcaacctctagttgcctgtcagatatatttaaaaagatatctctgcataaagtaggaggttagacttggcaattgccagtctcttctaaatgtatccttttgttgccttttttaaaaaaaaaaaagctttttctgacaacattttaccgacagactactttggttctcttttgtaagaattgctaaagtttgtcgacatttaatgtttactgtcacatttctttgtacaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggagtaagttccattcgttaaatgtcttgtaaattatttttgaagaccattgaggatgttttaaaggttttggctgctattcttttggattgcattttaaattactgtccaggaacataaggatgctaactaatggctggtaaataatatgatactaaaaaataaatgtctctgtctagtgcagccttcagaacatatatcaagtatttgataataaatacatgactgcaaacttaggcttagcactcagtgattgagctaagcaagagaggttcagaagatagaaacagcaaaaacctgctaaaaagttgttagcagttgtgcaagtaaacagaatggttgttagttactttttcaaatcagtttctctgagtgcccgtatttttggttgcaaaatggtcagttaataaagttaaagtgaaaaatctgcattctgaccctttttgaggatttcagagtgagttcctatctgttgaattttgctatgcaatttaaggagttat

SEQ ID NO: 156 - DNA, 1047 bp, Homo sapiens
actacataagttgagcagtgaaagagcactttcagttcggttagtcatgggaaagcttcactcaggagttagaatttgtattcagttttaaaggatggatatgaataggtggaaaatagaacgaaagctaacttggagggttgggtgtaggaggggagcattgaacacagtggtgggattaaatatcaaggtatatttaagggacatggataaataggcttgactggagtgaaaggtttgtattggtaactagtaaaagataaagcaaagtcttttaatagaaaacaagattttgactgtaccattatagtgatatgttcctataatcttaaattcatttacagtctattttaatattctgtgaagggtttattacaatgtactattttcagttgtatcatgattctaaataagtctttacacccccaagtatgttctgtagatttcgaggccagagtcctttagccctactcaggttaaaatgatgttttgtttttcagttacttacacgccaagtcaatcatccacagagacctcaagagtaatagtatccttcctgaaatttgtctgcgaagtttgaaaacatcctgactttttcttctgcattttgtcttcacattatgtaaaaacagttttcatgctaagttcgatatactgtaaagagaattaataaaggattgtgcatgcatgtataggagagcaggataccacagcctgcttttggtttctcgacaactgaacattacaagaaaatctatcagaagtctttacaatagtaggagtttttgattgcttgcttacattttatcagcactataaaactgatagttttgtagctatctattagtccctttcagacctctgaccttgctcagtggtagttgagatataactgaagactctaaattatataacaatgaggtgagaaaaacataatatttctcttccctaagtgcagactaagatactatctgcagcatcttcattccaatgaagagcctttactgctcgcccaggagtgccaagagaatatctgggcctacattg

SEQ ID NO: 157 - DNA, 1119 bp, Homo sapiens
ctattagtccctttcagacctctgaccttgctcagtggtagttgagatataactgaagactctaaattatataacaatgaggtgagaaaaacataatatttctcttccctaagtgcagactaagatactatctgcagcatcttcattccaatgaagagcctttactgctcgcccaggagtgccaagagaatatctgggcctacattgctaaaatctaatgggaaagttttaggttctcctataaacttaggaaagcatctcacctcatcctaacacatttcaagccccaaaaatcttaaaagcaggttatataggctaaatagaactaatcattgttttagacatacttattgactctaagaggaaagatgaagtactatgttttaaagaatattatattacagaattatagaaattagatctcttacctaaactcttcataatgcttgctctgataggaaaatgagatctactgttttcctttacttactacacctcagatatatttcttcatgaagacctcacagtaaaaataggtgattttggtctagctacagtgaaatctcgatggagtgggtcccatcagtttgaacagttgtctggatccattttgtggatggtaagaattgaggctatttttccactgattaaatttttggccctgagatgctgctgagttactagaaagtcattgaaggtctcaactatagtattttcatagttcccagtattcacaaaaatcagtgttcttattttttatgtaaatagattttttaacttttttctttacccttaaaacgaatattttgaaaccagtttcagtgtatttcaaacaaaaatatatgtcttataaacagtgtttcatattttattcttaaataaatatgaacccttaaaacgaatattttgaaaccagtttcagtgtatttcaaacaaaaatatatgtcttataaacagtgtttcatattttattctaaattgtttaaagtattttgtgttcaaaatgttctgtgtaccctgttgaaaaaaaaaacaggtatgcaatttaaggcaggtgtgatccacagccattattatggttttgctaagagaactactccttttaacagagaagctgtt

SEQ ID NO: 158 - DNA, 1132 bp, Homo sapiens
tttatcagtcctgaaattctaccattattttctaaggtgtcctcagatgagaaaagttgtttgtaccaatgggaaaacttaaattgtaagacagttactacagtagttgtgctgctcctaagcatcttataaccacaagtctagtatttctttgctgaatcaggaatgggaagtgggaactgattctaatagggtaagtcatgggaagaattcatctggcaatgatggtattttctgcagaaagattgcctaaataattactaaattataaaatcttagtaatacaatacaaaatctctgctaatactgtctctttctgagtatgtagaggtttttttcttcagcttaatcagttttatttctttgactattaagagaattgattacatattagacaggtgttttaatggtaaaagcattgctctaggaattatagtaggttgtttttcagtctttattcaattgaagtgaagaatatttttctttgtatgttctaacaggcaccagaagtcatcagaatgcaagataaaaatccatacagctttcagtcagatgtatatgcatttggaattgttctgtatgaattgatgactggacagttaccttattcaaacatcaacaacagggaccaggtaaatatttaccacgtcttggtgtttattttaccgtctatatacaaggctccagttgtagaaaataagtgttaactcctgggtaagcgtgaaggatagatttcttgattttttgttaccagttttagaaatcgtttgtatacttttggcagtaatagcaacacgttaagtcctttcctcagaatatcagtcatgaatgttacaatggaataaaattcctgattttctgactagaaactacagttacaagaatggatatttcttgaccatcgcacaattagaagaatgagctctgctactatagcatctgggcattatacttttcactgtatcacagattgtgctgtcagaacaggtactcagctatgagatctttatattaaattcttttaaaattactaaggtttcttgaaatctttaatttttaaaactaggtaaatggaagaaatcatgctttgatttttctataatgagaatgctagtaggagggtaatttttta

SEQ ID NO: 159 - DNA, 1135 bp, Homo sapiens
tctggtttgtataaccaagtggcccattagcgtttccacaataaaagggcttaagatgcagatgccaaaacgactgctaaaatgttaacctttttggttttccctacacatatatagaggacttaacacaacgtccaacaacaagaagtgctgaataaattttttttttttttaaagtaaagaagaggcactgtcagatctgttttagatggttaccctgtgagtgggaaaatggactggataaagagagaccaaaagcaggggagcaattagagaacctttgccacagtccaaggatcatgaagatttgagcttgcactccttttgtgggtttcccaccatctatgatgtggcattggttttttaaaactttttattgaggtgtaatacatacatcgtaagctgtaaatgtacagcttattgtgttttcaatgagtgtgaagtatatttttcaacttatctacaaggttgaattatttcccttttttttctctctccagataatttttatggtgggacgaggatacctgtctccagatctcagtaaggtacggagtaactgtccaaaagccatgaagagattaatggcagagtgcctcaaaaagaaaagagatgagagaccactctttccccaagtaagtaaaagcttcatgctatccaaaagaacagactaacattcatagacagatttctgagcacttttttgggcacacagtgtgtatttcatgagtttggattctatgtgcagactccagacaagaaaacacattaagatggcttcatgagggttgagcagtggcacacctagaaattttgggtcctaatacaaaatattcagaaagactttgcatttgtccatcagttctcagacttctcagtctttgaactcttttacacatttaaaaattatcgaagacccccccccccacaaagagcttttgtttatataagttttaattccttattagaaattaaaactattttttaaaatattaatgaattaaacatagtaaaccaatatgttaaataatatttagaaaaaaacagttctattatctaagagaaaaaaattagtgaggagttgtattgttttactttttttgcaaatccctttgcaaaaagaagacagctggat

SEQ ID NO: 160 - DNA, 1758 bp, Homo sapiens
ttctgctttcaattaggtgtatgtaaaacatttcccatggctaggtttctttaaagggcaagtagctgtgataattctgtttagagatagtcataaagtgctttacttatttatactccatcttcttcccaaaagagacttgtggtctataacaaaaaggtataaaattggttttaaatttctattatttactgtttcaagactaacaaatgatctaaaatataaataaaagctgactaagaattactctccccatttaatttacagagagagtttcttcttaagaaaaaataccaattatttacaaatattttcccaagcatttatgacaatgctgaaaacaatgtaagatttcaggtgctttcttgtaaagtgtgatgggactcttaaagatttataccacccagattttcattcttctttctgttttttctttttctttctttctttttttttcttttttctttttttttcttttttttttctttttttttttgtagattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaattttgagtgcaggtgaccaaaaatattgctgaggagtggcacgtttgacatgagtaaaatgtcttaacttcggatttttagcgggaaaatgttataaattggagtttcttttaaatagctttttttaaaatacattaaggatgtctcgctcatgtagaagtcaaattttgttgcaaacgcattgctcccttcacacccaatctctcccctgcaaaaaatcttcacagaattctgtgagaacttttaggtgtgtttttctttgagatacctctggttgccaaacaccaggtaatagattttttaaagttgttattagattattcttacctctcatgatgcatattttagcaatcaccttatcattgtgtctcatgttctgtcctccttatattctttgcccagcaagattctacttatgatgaatgaatgctcttctccttttttcattcaatggtatgaagtatttgttagggttctttagtacttacactttgttgtg

SEQ ID NO: 161 - DNA, 1500 bp, Homo sapiens
aatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaattttgagtgcaggtgaccaaaaatattgctgaggagtggcacgtttgacatgagtaaaatgtcttaacttcggatttttagcgggaaaatgttataaattggagtttcttttaaatagctttttttaaaatacattaaggatgtctcgctcatgtagaagtcaaattttgttgcaaacgcattgctcccttcacacccaatctctcccctgcaaaaaatcttcacagaattctgtgagaacttttaggtgtgtttttctttgagatacctctggttgccaaacaccaggtaatagattttttaaagttgttattagattattcttacctctcatgatgcatattttagcaatcaccttatcattgtgtctcatgttctgtcctccttatattctttgcccagcaagattctacttatgatgaatgaatgctcttctccttttttcattcaatggtatgaagtatttgttagggttctttagtacttacactttgttgtgtagaaaatgactgtaatgtggtggtcagtgtattcttactgtgattcagagggaatcaaaagtagaaagcaacagcacgtggtcctatcaaagatttggccatctctgcttcactgtcagcctcttaactatatcttcacttactcaatttggttttgtcatgatttttaaatgtagccaatagatcaaggttcttccagtaaacacatatctgcataaatgcctccttgaagtcaataaagaaggaaattgagaagactttaaattaatgataatttagtttttaagtacccacaaataaatttttgaaacattttctttatttgaatacttagatgtcatccaggaaaatcactcaataataattacggcaaatctttaacccctcatttgggtagcttaagataagtaatgccattatgaatcagaattgattcatgactttagttaagaaaatgaaaaggaacatttcacgtatttttaaaaatgatactaaggaa

SEQ ID NO: 162 - DNA, 7224 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 163 - DNA, 7287 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 164 - DNA, 7132 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 165 - DNA, 3699 bp, Homo sapiens
ttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 166 - DNA, 3800 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaaaaaaaaaaaaaaaaaa

SEQ ID NO: 167 - DNA, 1500 bp, Homo sapiens
ccacccctagctaacccaggctgcttccttaccagcttcccgccccctggggaggcggcaatgcaaagaccgtccgctgccagctctgccgctatctctgtggggtgaatctaacatggcggacaaagacagtaactagtcccgtttctccgcgttttcgccaagaagattggctcttaccacttgtccctcaaaacgaccaccccattgactggtggcgattgcgtcgacggagacggggcaaaagcaagctgaacccgaaaaataacaaacactggggctgaggggtggaactacgagtgcgcagacatgggccagagcgcatttcccctgccccaggcaaattcggcgctcactgcgtccccgcaggccactgaccttacaagactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctgg

SEQ ID NO: 168 - DNA, 1213 bp, Homo sapiens
gtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaaca

SEQ ID NO: 169 - DNA, 1099 bp, Homo sapiens
aaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgattttcttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaa

SEQ ID NO: 170 - DNA, 1054 bp, Homo sapiens
cattttattattttatttacttgaaattttgaaatacttgaaattttccatattaagttaaaaaggcatttacagtaaacaaaaaaaagttctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacaccc

SEQ ID NO: 171 - DNA, 1078 bp, Homo sapiens
cgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagat

SEQ ID NO: 172 - DNA, 1089 bp, Homo sapiens
tcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccatcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgacactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgt

SEQ ID NO: 173 - DNA, 1140 bp, Homo sapiens
gttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttcttttcttttttttttcttttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagacctta

SEQ ID NO: 174 - DNA, 1106 bp, Homo sapiens
gacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaaga

SEQ ID NO: 175 - DNA, 1046 bp, Homo sapiens
tgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactga

SEQ ID NO: 176 - DNA, 1077 bp, Homo sapiens
ttgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcag

SEQ ID NO: 177 - DNA, 4426 bp, Homo sapiens
gtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagc

SEQ ID NO: 178 - DNA, 1089 bp, Homo sapiens
tggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagc

SEQ ID NO: 179 - DNA, 1172 bp, Homo sapiens
ttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaa

SEQ ID NO: 180 - DNA, 1066 bp, Homo sapiens
cattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgtccacctcggcctctcaaagtgctgggattgtaggcgtgagccacatcacctggccacttttttaactctttccaatggttaattccgtttgatatggttccttggaacttgcacattaccctttatcaattatcaccct

SEQ ID NO: 181 - DNA, 1124 bp, Homo sapiens
ctcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctc

SEQ ID NO: 182 - DNA, 1191 bp, Homo sapiens
tctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcttgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcg

SEQ ID NO: 183 - DNA, 1311 bp, Homo sapiens
agccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattagga

SEQ ID NO: 184 - DNA, 1088 bp, Homo sapiens
acgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcac

SEQ ID NO: 185 - DNA, 1078 bp, Homo sapiens
tctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggacagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttag

SEQ ID NO: 186 - DNA, 1041 bp, Homo sapiens
gtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgc

SEQ ID NO: 187 - DNA, 1084 bp, Homo sapiens
tctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcc

SEQ ID NO: 188 - DNA, 1055 bp, Homo sapiens
gtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccacggacgggcccagagcaggggaagattctcggtgaacatttctttttttttttctttttttttgaggtcgagtctctgttgcccaggccagagtgcaatggcgcgatct

SEQ ID NO: 189 - DNA, 1074 bp, Homo sapiens
ctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaaacaaaaagtagccaggcctggtggagcatgcctgtaatgccagctatttgggaagttgaggtgtgagc

SEQ ID NO: 190 - DNA, 1061 bp, Homo sapiens
gagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttaggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcct

SEQ ID NO: 191 - DNA, 2508 bp, Homo sapiens
gctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaaaccagcaatgggtggtcaagtttttctcacactgaatcttgctgactactgtatctttctaactcctgccagagacatttctctgtttctaagggctcaagtga

SEQ ID NO: 192 - DNA, 1500 bp, Homo sapiens
actagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaaaccagcaatgggtggtcaagtttttctcacactgaatcttgctgactactgtatctttctaactcctgccagagacatttctctgtttctaagggctcaagtgattagattgcacccacttggtaatccaaagtgatcttcatatcttaaggcccatagccttaattatagctgcaaagtcccttcgcagcagtacctagattactgttggaatgaataaccagaagacagcaatcaagggaggacatctttagaattctgcctaccacttgtatttaacatgcttaatccacagatgacactctctaccattatttcctggtcctcacactgctcagagattggaatcctttttgagcaaagagaatgaagtcatcacatagttcagtcctgctgtatttgctggaaacagtgaaggaagatagagaaaatggagctaactgccaatattacattttatatcagtcttcatcatagccctatgaagtgggtatttgttacctcattggaaaaatgggagttgaatctcaagttccttgtttgtaagattttactcagatttgcacagctaaaaatgactacatggagacccaaagccaccttt

SEQ ID NO: 193 - DNA, 11386 bp, Homo sapiens
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgatt

SEQ ID NO: 194 - DNA, 1500 bp, Homo sapiens
agaaccaacgaattcggagatgaagtcaggtcttccagttcagcctgcgaggaagacaggtgatccgaatcctaagaatgcaaaagatgggccgggtgtggtggctcatgcctgtaatcccagcgctttgggaggccgaggcaggcagatcacctgaggtcgggaggttgagaccagactgaccaacaacggagaaaccccgtctctacttaaaaatgcaaagttagccgtgcgtggtggcccatgcctgtattcccagctactcgggaggctgaggcaggagaaccacttgatccctggaggcggaagttgcggtgagcggagattgcgccattgcacaccagcccgggccacaagagcgaaactccgtctcaaaaaaaaaagcaaaagatactaccaagccctgcggagcaaggtacctcacacttcatgagcgagttaagatgggtttcacaatttttcaagcaaggaaacgggctcggaggtcttgaacacctgctacccaatagcagaacagctactggaactaaaatcctctgatttcaaataacagccccgcccactaccactaagtgaagtcatccacaaccacacaccgaccactctaagcttttgtaagatcggctcgctttggggaacaggtcttgagagaacatcccttttaaggtcagaacaaaggtatttcataggtcccaggtcgtgtcccgagggcgcccacccaaacatgagctggagcaaaaagaaagggatgggggacttggagtaggcataggggcggcccctccaagcagggtggcctgggactcttaagggtcagcgagaagagaacacacactccagctcccgctttattcggtcagatactgacggttgggatgcctgacaaggaatttcctttcgccacactgagaaatacccgcagcggcccacccaggcctgacttccgggtggtgcgtgtgctgcgtgtcgcgtcacggcgtcacgtggccagcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcgggttagtggtggtggtagtgggttgggacgagcgcgtcttccgcagtcccagtccagcgtggcgggggagcgcctcacgccccgggtcgctgccgcggcttcttgcccttttgtctctgccaacccccacccatgcctgagagaaaggtccttgcccgaaggcagattttcgccaagcaaattcgagccccgccccttccctgggtctccatttcccgcctccggcccggcctttgggctccgccttcagctcaagacttaacttccctcccagctgtcccagatgacgccatctgaaatttcttggaaacac

SEQ ID NO: 195 - DNA, 1188 bp, Homo sapiens
acccaatagcagaacagctactggaactaaaatcctctgatttcaaataacagccccgcccactaccactaagtgaagtcatccacaaccacacaccgaccactctaagcttttgtaagatcggctcgctttggggaacaggtcttgagagaacatcccttttaaggtcagaacaaaggtatttcataggtcccaggtcgtgtcccgagggcgcccacccaaacatgagctggagcaaaaagaaagggatgggggacttggagtaggcataggggcggcccctccaagcagggtggcctgggactcttaagggtcagcgagaagagaacacacactccagctcccgctttattcggtcagatactgacggttgggatgcctgacaaggaatttcctttcgccacactgagaaatacccgcagcggcccacccaggcctgacttccgggtggtgcgtgtgctgcgtgtcgcgtcacggcgtcacgtggccagcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcgggttagtggtggtggtagtgggttgggacgagcgcgtcttccgcagtcccagtccagcgtggcgggggagcgcctcacgccccgggtcgctgccgcggcttcttgcccttttgtctctgccaacccccacccatgcctgagagaaaggtccttgcccgaaggcagattttcgccaagcaaattcgagccccgccccttccctgggtctccatttcccgcctccggcccggcctttgggctccgccttcagctcaagacttaacttccctcccagctgtcccagatgacgccatctgaaatttcttggaaacacgatcactttaacggaatattgctgttttggggaagtgttttacagctgctgggcacgctgtatttgccttacttaagcccctggtaattgctgtattccgaagacatgctgatgggaattaccaggcggcgttggtctctaactggagccctctgtccccactagccacgcgtcactggttagcgtga

SEQ ID NO: 196 - DNA, 1106 bp, Homo sapiens
gacttaacttccctcccagctgtcccagatgacgccatctgaaatttcttggaaacacgatcactttaacggaatattgctgttttggggaagtgttttacagctgctgggcacgctgtatttgccttacttaagcccctggtaattgctgtattccgaagacatgctgatgggaattaccaggcggcgttggtctctaactggagccctctgtccccactagccacgcgtcactggttagcgtgattgaaactaaatcgtatgaaaatcctcttctctagtcgcactagccacgtttcgagtgcttaatgtggctagtggcaccggtttggacagcacagctgtaaaatgttcccatcctcacagtaagctgttaccgttccaggagatgggactgaattagaattcaaacaaattttccagcgcttctgagttttacctcagtcacataataaggaatgcatccctgtgtaagtgcattttggtcttctgttttgcagacttatttaccaagcattggaggaatatcgtaggtaaaaatgcctattggatccaaagagaggccaacattttttgaaatttttaagacacgctgcaacaaagcaggtattgacaaattttatataactttataaattacaccgagaaagtgttttctaaaaaatgcttgctaaaaacccagtacgtcacagtgttgcttagaaccataaactgttccttatgtgtgtataaatccagttaacaacataatcatcgtttgcaggttaaccacatgataaatatagaacgtctagtggataaagaggaaactggccccttgactagcagtaggaacaattactaacaaatcagaagcattaatgttactttatggcagaagttgtccaactttttggtttcagtactccttatactcttaaaaatgatctaggacccccggagtgcttttgtttatgtagcttaccatattagaaatttaaaactaagaatttaaggctgggcgtggtggctcacgcctgtaatcccagcactttgggaggccgaggtgggcggatcacttgaggccagaagtttgagaccagcctggccaacatggtgaaacccta

SEQ ID NO: 197 - DNA, 1249 bp, Homo sapiens
gactacaggcgtgtgccaccatgcttggctaattttttgtgtttttagtaaagatggggtttcaacgtgttagcaaggttggtctcgatctgacctcgtgatctgctcgcctcagcctcccaaagtgttgggattacaggcgtgagcccccgcacctggccgaattttatcgtggaatgtattcttaatgtgaatagtttttgattccgaaccatgaataataagaaaataaataaaatttaaatgaaaataaaagctaatatatacagcttttaataatatagttaaatgccatcttgtaacttttgtgaactcttgttacacctttctatagattcgcaagagaatggattaatgatcttgtttaattaatatgccttaacaaaagtaatccatagtcaagatcttaagcatttttttccttatgatctttaactgttctgggtcacaaatttgtctgtcactggttaaaactaaggtgggattttttttttaaatagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggtaagtaatgcaatatggtagactggggagaactacaaactaggaatttaggcaaacctgtgttaaaatcttagctcattcattaattgtgtcatgctgggcaaatcagtctctctggcctctttttcctcactcgaaaaatggagacgatgaaaataatgtctcataggtttggattaaattaaataatgtaggtacttagtaaatgttctctttcatccctcctttgataaatttgccaactgagatttgctgaattacgtctttcttatgccaaaaaaacctaggacttgttttgatgttaattaaactaaactatatttctgcaagctatcacagaggacagagattattttaccgatatactataagtatcatgatttggaaggagtttccctggcgtaggtgccgcatgtttctaagcaattatgtaataagattatatattcagtcattcaaataattattacctacttgacataagtaatgaactttccctt

SEQ ID NO: 198 - DNA, 1109 bp, Homo sapiens
gtcagatctggtacattggtaggttttcagtaaatgtcttcccttactccttttttctctttccttctgcttttgtttaaagcgacaagatgttgctcttttcccaggctggaatacagtggcatgatcatagctcaagctcctgggctcaagtgatcctcccgcctcagcctctcaagtagctaggactacaggcatatcaccacaccagcgttttctttgtagaggcagagtctcactctgttgctcaggcaggtgttgaactcctgcctcaagcaatcctcccacctcagcctcccagagccctcaaattataagccactgtgctcggggcatcctttttggggggtaatcagcaaactgaaaaacctcttcttacaactccctatacattctcattcccagtatagaggagactttttgtttttaaacacttccaaagaatgcaaatttataatccagagtatatacattctcactgaattattgtactgtttcaggaaggaatgttcccaatagtagacataaaagtcttcgcacagtgaaaactaaaatggatcaagcagatgatgtttcctgtccacttctaaattcttgtcttagtgaaaggtatgatgaagctattatattaaaatatttaaatgaaacattttcctacatatatttgttctataaagatgaatctgatttttatgctaatattttggctaagagcctggtagaagatcttacatttttaaataatcttttaggttgagtcctttaatagaatagtttttacattagaaacatgtaagttgttgttcttgtgatgttgaattggctggttttctgtatattctgtgattttttaagtaacaaaaataacagtggtgaaaagcagtaagtcagtccttgaattatcaatttaaaataaattgtgtacttttcatctttggagagaatatgatttactttacaaattttttttttgttttttttttttttgagatggagtctctgtcacccaggctgtagtgcagtggtgcgatctcagctcactgcaagctccgcctcccgggttcacgccattctcctgcctcagcctcccaagtagctgggactacagg

SEQ ID NO: 199 - DNA, 1050 bp, Homo sapiens
tgcgatctcagctcactgcaagctccgcctcccgggttcacgccattctcctgcctcagcctcccaagtagctgggactacaggcgcccgccaccatgcccggctaattttttgtatttttagtagagacggggtttcaccgtgttagctaggatggtctcgatttcctgacctcgtgatccgcccgcctcagcctcccagactgctgggattacaggcgtgaaccactgtgcccggcctactttacaaaatttttgagtttaaaatacacggtttccagcagctgaaatttgtgagtacatatgtgttggcattttaaacatcacttgatgattatttaatgcttcatgagagatttactttttaaaatgtaatataaaatatctaaaagtagtattccaacaatttatatgaatgagaatcttcttttaaaaataagataaactagtttttgccagttttttaaaataacctaagggatttgctttgttttattttagtcctgttgttctacaatgtacacatgtaacaccacaaagagataagtcaggtatgattaaaaacaatgctttttattcttagaatactagaaatgttaataaaaataaaacttaacaattttcccctttttttacccccagtggtatgtgggagtttgtttcatacaccaaagtttgtgaaggtaaatattctacctggtttatttttatgacttagtaattgagaatttgacaatagcgttatacctttgccctgagatttacaaatctgtacctagcattctgcctcatacaggcaattcagtaaacgttaagtgaaataaagagtgaatgaaaaaataatatccttaatgatcagggcatttctataaaaaataaactattttctttcctcccagggtcgtcagacaccaaaacatatttctgaaagtctaggagctgaggtggatcctgatatgtcttggtcaagttctttagctacaccacccacccttagttctactgtgctcataggtaataatagcaaatgtgtatttacaagaaagagcag

SEQ ID NO: 200 - DNA, 1041 bp, Homo sapiens
gtgttagctaggatggtctcgatttcctgacctcgtgatccgcccgcctcagcctcccagactgctgggattacaggcgtgaaccactgtgcccggcctactttacaaaatttttgagtttaaaatacacggtttccagcagctgaaatttgtgagtacatatgtgttggcattttaaacatcacttgatgattatttaatgcttcatgagagatttactttttaaaatgtaatataaaatatctaaaagtagtattccaacaatttatatgaatgagaatcttcttttaaaaataagataaactagtttttgccagttttttaaaataacctaagggatttgctttgttttattttagtcctgttgttctacaatgtacacatgtaacaccacaaagagataagtcaggtatgattaaaaacaatgctttttattcttagaatactagaaatgttaataaaaataaaacttaacaattttcccctttttttacccccagtggtatgtgggagtttgtttcatacaccaaagtttgtgaaggtaaatattctacctggtttatttttatgacttagtaattgagaatttgacaatagcgttatacctttgccctgagatttacaaatctgtacctagcattctgcctcatacaggcaattcagtaaacgttaagtgaaataaagagtgaatgaaaaaataatatccttaatgatcagggcatttctataaaaaataaactattttctttcctcccagggtcgtcagacaccaaaacatatttctgaaagtctaggagctgaggtggatcctgatatgtcttggtcaagttctttagctacaccacccacccttagttctactgtgctcataggtaataatagcaaatgtgtatttacaagaaagagcagatgaggttgataattgtcatctctaatacttctgttaaaaggaaatatgaaaagaaaatattagataatgtctttgataagtgtgttagtaactgacaataattttattctattaagtgtagattggaataa

SEQ ID NO: 201 - DNA, 1115 bp, Homo sapiens
ccaacaatttatatgaatgagaatcttcttttaaaaataagataaactagtttttgccagttttttaaaataacctaagggatttgctttgttttattttagtcctgttgttctacaatgtacacatgtaacaccacaaagagataagtcaggtatgattaaaaacaatgctttttattcttagaatactagaaatgttaataaaaataaaacttaacaattttcccctttttttacccccagtggtatgtgggagtttgtttcatacaccaaagtttgtgaaggtaaatattctacctggtttatttttatgacttagtaattgagaatttgacaatagcgttatacctttgccctgagatttacaaatctgtacctagcattctgcctcatacaggcaattcagtaaacgttaagtgaaataaagagtgaatgaaaaaataatatccttaatgatcagggcatttctataaaaaataaactattttctttcctcccagggtcgtcagacaccaaaacatatttctgaaagtctaggagctgaggtggatcctgatatgtcttggtcaagttctttagctacaccacccacccttagttctactgtgctcataggtaataatagcaaatgtgtatttacaagaaagagcagatgaggttgataattgtcatctctaatacttctgttaaaaggaaatatgaaaagaaaatattagataatgtctttgataagtgtgttagtaactgacaataattttattctattaagtgtagattggaataaatacaaatacatttagtggtagtccagtggtgtcaagcattatgttttagtacgatgtgattaacgtagaatagcttacaaatattcctttactggcctatataagcgtttaagaggcagtatttggtgtgactgaattctttttacaaatgattgtggtaattggggcattaaagcagcattaaataagcttttgttttctctacttaaatgtgttctaaggtctgtattgccagtagtactgaattgaggtcttaaattccacaagtgtaattacacaactatgtgataaactgcaatatttatccattcattaaactgtaaactcttt

SEQ ID NO: 202 - DNA, 1050 bp, Homo sapiens
accagtattacattttgtttattctagcaaaatagcattctgttttgattcctctttagctgggagtaagttaaccctattctgttgcttagatgaaataatatggataaaatcattttgaaaatatgtatttaatatatagtatgcctttaggctgtagtgttgtctaaatgaatgctaaagtctccaagctttagcttttaagtcataacctcacagcatcatctgactttccaactcattgtggacagtattaccataaagtaatgatcaccaagccatatcttaccaccttgtgagtagtactaaggaagtaagtatagtttattcactgtgttgattgacctttctaattactatacttaagtacttgaatcaattcattttgtttcaaatgtgtcatgtaatcaaatagtagatgtgctttttgatgtctgacaaaaaataagtttttgcattctagtgataatatacaatacacataaatttttatcttacagtcagaaatgaagaagcatctgaaactgtatttcctcatgatactactgctgtaagtaaatatgacattgattagactgttgaaattgctaacaattttggaatgccttgttaaattatttatcttacatttttaatttcctaatctgtaatttatctaagcctttgagaaagtctctaaacctggtcctatatgtgattttaacttcctgtgaaactctgctgtctctctgttaaagttgcatatatacaatatataccgtagtcccctattcatggggtatacattccaatatcccccagtgaatgcttgaaaccttagatagtaccgaaccctatatatatatattaaaaatgtgtagtatttatatatatatacctataatctttttttctataagcacataccctgtgataaagtttaattcataaattaggcacagtaagagattaacaagaactaataataaaataggacaattataacaaaataccgtaataaaagttatgtgaatgttgtctctctgtctcaaaatatcttattgttctgta

SEQ ID NO: 203 - DNA, 1112 bp, Homo sapiens
gcactttatggcttctttttggcatatttgaattgccagcatcattatacttgtgctttggggccattgttaagtaaaataagggtgacttgaacacaagcactgtggtaccacaatagccgatctgataaccaagacaactactaagtgactaataggtgggtaccatatacagcctggatacgctggacaaagggatgattcatgtcccaagtgggatggagcaagatggtgcaagtttttttttctccatttccattttcctttcctaagatttccacatcctagtggtgcaagatttcatcacactactcaggatgacacacaatttaaaacttactaattgcttacttctggaattttccattaaaaatttttggacctaggttgattgcagataactgaaatcaccaaaagtgaaaccatggataaggggggactactactatatgtgcattgagagtttttatactagtgattttaaactataatttttgcagaatgtgaaaagctatttttccaatcatgatgaaagtctgaagaaaaatgatagatttatcgcttctgtgacagacagtgaaaacacaaatcaaagagaagctgcaagtcatggtaagtcctctgtttagttgaactacaggtttttttgttgttgttgttttgattttttttttttgaggtggagtcttgctctgtcacccgtgatctcggtttaccgcaacctctgcctcccgtgctcaagcgatcctgcctcagcttgccaagtagctgagattacaagcatgcaccaccatgcccaactattgtatttttagtagagatggcatttcaccatgttggccaggctggtctcaaatggtcgtgagccaccatgcccagcctgaactactctttttaattggcaccattgaaggattgctcctcttttcttaaagagaaaatatattacctttcctttcttgactactgaagtagtattttatctcaaagtattgagagtagaaactaacttggtgtgcctgtgatcccagctactcaggaggctgaggtgggaggatcgcttaagcccaggcggtcaaggttgcagtgagctgtgtgtgtgccactgcact

SEQ ID NO: 204 - DNA, 2116 bp, Homo sapiens
aggtcatggaatattgcatttttcttagtatgtgtgtatgtctgtataactgtgtaggatttgatatctgtttttgtctgtgtggtatcatgtacgtatgtatatgcatatgtaaaatcagatttacccttgttatagggccacagaattgatttggaacatctgttttgataggtcttagaatatttaattgtatatatagtaagattaggtgagttttaattgtgtagaactgctaaagaaaggtttttagggattgttgtatgaataaaaggctttaggttcattggaatcaggggaatcaggctttactagaagaacaggagaaggggtgactgaccgaaaaataaaatgccaagtactcagaataaccctttaaatactgatatgtaatatttagcacattctacataaactgtttctatgagaaaggttgtgagaataatataaattatatggcttataaaatattaatgtgcttctgttttatactttaacaggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtacctctgtctttttttttttgtaaatagtacatatagttttatagatgacgattccttctgtgtttttttctgctttttaaaatcttcatatcttatatttaatcttaggcatcatctgtatacatgattgtttaggtctttaattaccagtgtttagaatcaggtcactcaaacatggtagataagtttgcatagtttgtgtatatccatcactcttgagacagttttattttaagttccggggtacatgtgcaggatgtgcaggtttgttacataagtaaacgtatgccatgttggtttgctgcacctgtcaacccttcacctgagtattaagcccagcatgcattagctatttttcctggtgctctccttccccccacacacccccacctcctgacagaccctagtgtgtgttgttcccctccctgtgtccgtgtgttctcattgttcagctcccacttatgagtgagaacatgtgatgtttagttttctgttcc

SEQ ID NO: 205 - DNA, 5932 bp, Homo sapiens
tgagctaaaaaatgtaataactgaaaaatagagcatatttaggattctttctgctttaaatttgacattcagttattttcatgtaatttgtgttttgagcactaccttttaattaatttatttatttttattttttagagactgtctcattctgttacctagtctggagtgcactagtgtgatctcagctcaccgtagcctcaccctcctgggctcaagcagtccttgcacctcaccctcctgagtaactggcaccacaggcatacaccaccacacccagctaatttttatttttcatagagtcatggtctcactatgttgcccaggctagtctcgaactcctgggctcaagcagtcttcctgcctcagcctcccaaaagtgctgagattacaggcatgagccactgtgcccaaacactacctttttaacttagtgaaaaatatttagtgaatgtgattgatggtactttaattttgtcactttgtgtttttatgtttaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggtaagtgttcatttttacctttcgtgttgccaatcactatttttaaagtgtttattcagtagacttggtatgctaacaattaagagtgttataaactatgtcttttcagccatttttgtgtagtcagtttgggggagtatggtttgatatacagatacacagattcagtattcgtatacagatttgatatcttggtatacagattcgatatctctgaatctgtataccaagaaatcatgttttaagggtctcaatatattttcaaaaagattattagtataataattgagaaattactgttaaaaagttttgagtttctctagaaaatttgaaactcttaacaaaacctgcataatactaacttaactgttttcatatacatagcaagttcagactctgacttatatgaactttaaaagttggtttccgggaggccgaggcgggcggatcacgaggtcaggagatcgagaccatcccggctaaaacggtgaaaccccgtc

SEQ ID NO: 206 - DNA, 1096 bp, Homo sapiens
ctattactagtactttaatgtaatttgataattgtaaaaagcctcttaactctaattcaaggacctacataataaattactccttcagttaatggctgcccccgtgctgaaaaaaaaaaaaaaaaagagagaaaaagtttatttgaagaaattttgttaggccttattgccagtaaacctagagttatatttagtgtcagtttttcaaaaagtagcttatctgtggtatctggtagcatctgtttatcctatttaggatttatcctgtttagaccctgttaaatagtggtgttttaaagtggtcaaaacagaacaaaaatgtaattgacattgaagactgactttactctttcaaacattaggtcactatttgttgtaagtatttttgtttaacatttaaagagtcaatactttagctttaaaaaaatggtctatagacttttgagaaataaaactgatattatttgccttaaaaacatatatgaaatatttctttttaggagaaccctcaatcaaaagaaacttattaaatgaatttgacaggataatagaaaatcaagaaaaatccttaaaggcttcaaaaagcactccagatggtaaaattagctttttatttatatctgttctccctctataggtatggtatataatattctgacctcaggtgatccacctgcctctcaaagtgctgggattacagacatgagccactgtgcctaatcaaggacctctttatactcttaaaaattactgaggacctaaaagagcatttgtttatgtggaatatatctattgatatttaccatattagaaatgtaaattgattaatgttaaaattagtaatattatgcgttggtcatttggaagatatgagttcactgagttatgcggatcttccgaaagttgacagttttattatgcagtattaaacaatcactttcattgatgccattaccgatcagaaaagtttaagtagtagaaagctgtcaagcttacagagccagatacaagcttcccaaaaattctgattttcatctaaaagcttgaatttttccccggcaataagtattgtcacttatttttcttgtaggtgaca

SEQ ID NO: 207 - DNA, 1070 bp, Homo sapiens
gactccttaatgagtatatagagatcgtcctcattcttttttgtggttacatagtagttgatcatctggctgtgtcagtgtttcctagtttatttaaccaatttccaactagtggacttattgaagatttaattaggttccagttacatactgagaatgaacaatatctaaagcttagcttttaaaccttcataagactaaattttaaatttggtatttgcatcagaaattagctaacacctttgagttatgatggttaacatcaactgactaaatttatgctgatttctgttgtatgcttgtactgtgagttatttggtgcatagtcattatcaatttgtgaatcaatttattttcatagttaacatttattgagcatctgttacattcactgaaaattgtaaagcctataattgtctcaaattttttgtgtatttacagtaacatggatattctcttagattttaactaatatgtaatataaaataattgtttcctaggcacaataaaagatcgaagattgtttatgcatcatgtttctttagagccgattacctgtgtaccctttcggtaagacatgtttaaatttttctaaattctaatacagtatgagaaaagtctcgtttttataaatgaacatttctaaaaataatgacactaacgttaagaagttaacacttcccgttttataaaatttataaaatactttggtagtattttatagtgctgttcatatcattattttattttttaattttatgacagctttgtaaagtagacagattttattctaattttatggatgaagtactaaggttgagaggaattaaggaaattgctccgaatcagttaacaaaaagattgcagatattaaaaatatccttttatctctcctctctaaacctttaaaaaagtactaagatagtttttttaatgtataattcccaaggacaatgatgagaagaaacaacaaaagtttggaagccaaaaacataaaggatttagtaagcatgagaaagctaaaacctgacactagagcaaacagagatgctttcccctaaaaaacctga

SEQ ID NO: 208 - DNA, 1428 bp, Homo sapiens
gtgagtgagaaaataagagtttcaaaggtaggcaagatttttgggctaaataaaaagggcactttaaaaaaggtataaataggtagaagagagaaaagggagcgaggtgggataattgaaagaggggatctcctgtggagactgaggtattaggcggagtagagagttcaggtgaagatgtgaaggtgagagaagaggatgggtagacatttccctggtgaaggaggtaaggagtactatgatggaattagaggggacacactgagagggtccacacttgacagactctcttctattatgtgttatgtgaggtagattgtaaagtcaaaggctagccttgaaaaatgtgatattgttttggaatggcaaccatggtgaatacaaaacagttaccagaatagtatcaccatgtagcaaatgagggtctgcaacaaaggcatattcctaaatatttatatgtgtactagtcaataaacttatatattttctccccattgcagcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttaggtattgtatgacaatttgtgtgatgaatttttgcctttcagttagatatttccgttgttaaataatgtcctgatggttttccccctttggtggtggtaattttaaagccctttttaatgttttagattttctaaatccaaagattaggtttaaattattctaatgtttctttcaaagataacttcttgtggacttgttaaaaaaaattagacacacaatctaggactgctgttactggaatatattttctatcatgctactaattttctttttaaaatgtgataaaaatagggccgggcgtggtggctcatgcctgtaatcccagaactttgggagactaaggcgggcggatcacctgaggtcaggagttcaagaccagcctggccaacatagtgaaaccctgtctctactaaaaatacaaaataaataaataaataaataaatagctgagcgtggtggcaggcacctgtaatcccagctgcttgggaggctgaggcagg

SEQ ID NO: 209 - DNA, 1182 bp, Homo sapiens
acaagttgaaacatcctttcatttatgaagaattaaaaggggtaccctttttagagaaaaggagagcatgtaaacttcgaggaaattgatatgtataattttataaaacagggcttgcgcttttttttttttgagacagagtttcgctcttgttgcccaggctggagtgcaatggtgcaacctcggctcaccgcaacctcctcctcccgagttcaagtgattctcctgcctcagcctgctgaatagctgggattacaggcatgtgccaccacacctggctacttttgtgttttttttacttttatatattttttttttgtttagtagagacagggtttctccattttggtcaggctggtcttgaactcccgacctcagatgatctgcccgcctcagcctcccaaagtgctgggattacaggcgtgagccactgtgcctggccaggggttgtgctttttaaatttcaattttatttttgctaagtatttattctttgatagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacaggtatgtgtttgtctacaatactgatggcttttatgacagagtgtaattttatttcattaactagtatctacaaatggctttgtttaaagaatgaacacattagtgcaggaatggatgaatgaaatcatcatattttctaattagcctgcagtggcagcctctggccccttgctaggcctgcctcatcctgctaaagtgatctgtgcttccaaattactacttcttttcccccttcaaatctttcttattttgtcattgtaaatgctctcagctaggtgttaaagtagtcttactgatattcaaatgtgaataactgatagccctgaaccttctatgagctatttatattttccaaagaggattctccttaagccaatattatctaggtagaattttaggcaatggagaggtgaaaataatattgatgacattaatagctaactttgagcattttctaggtgtaagatgctcttctaagcacttcacatgcattaggtata

SEQ ID NO: 210 - DNA, 1188 bp, Homo sapiens
ctatgattccaaagcaaagagtctgactccagagtcaaactctgaacaaacaaaaagacactttgggttagatatcctggggtgaaagcaagcactttgaaagtaagccaagcctgtgtacagatctgaccacctgaggtcacattccctaaaatacttaaacttctcccttttgtttcccatctaagtttttgaacttaagagattttgtaaaacatcacatttttttatcctcacagtaccttcctatggcagatttagcaggaggcgtataaacggggtggaaaaggtacagcagactgtggaatgtatggatcatttatattacattaaaatttttagtttctagtaaataacttaaatgtttttgtagtgaagattctagtagttaatgaaaatttttggtaaattcagttttggtttgttataattgtttttattgtgtgatacatgtttactttaaattgtttttcttttttgtgtgtgtttattttgtgtagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttataggtactctatgcaaaaagattgtgtgttaacttttatgtattccctcatccctctttcttctcttaactgtctctcgaactaaaaagttggctagaaatcaaatttttatgcatttaattgttttaagtgcattatggttaagcattctgtagaagtcttttgaaaagtgctgtttgtcctggggtttaatgaactggattttcttgatttgggacatttttcttaggcatttataaatatagcccaatttataaagttaaatttggccgggtacagtggctcatgcctgtaatcccagcactttgggaggccgaggcgggtagatcacctgaggtcaggagttcgagaccagcctggccaacgtggcgaaaccccatctctactaaaagtacaagaactatctgggcgtggtggcaggcacctgtaatcccggctactctggaggctgaggcaggagaatcgcttgaacctgggaggcagaggttgcagtgagccaagat

SEQ ID NO: 211 - DNA, 1171 bp, Homo sapiens
ttgttttgtttttatattttgagatagggtctcactcttgtccaggctggagtgcagtggcactatcatggctcactgcagcctcaacctcctgggctcaagcaatcctcccaccacagcctcctaagtagctgggaccacagatgtgagctaccactcttggctgattttttttattattttttgtagagatgtgggggtctcactatgttgcctaggctggtctcaaacttctggcctcaagcaatcctcctgcctcagcttcccaaaatgctgggagtataggcatgagccaccatgctcagcaatgaagtttttatcagtatgatactttgatacatgtcaaataattttctgaaattatattgtagatcatatgaactcataaaaacttaatgatcttgaacaatgtagtttttgtacagagaatagttgtagttgttgaattcagtatcatcctatgtggtttttatgataatattctacttttatttgttcagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacaggcaagtttaaagcattacattacgtaatcatatacggcagtatggttaaggtttctgtgtagtctgtgacttccatgtcaaaatgttgcacaagccagttgtcagtgacagttgccatcccacactgctgttctcctgtcatccctagcccccatttaagagagatcacacattcatgcattgcttgcttccctctttccccaccccctccttaacctcttgatgtatgagaagaatatgagttactaatttgatccactatttggggattgctaataaagcatttttgcattttattttttgctttttaaaaataattgatattttaacaatatgaaacaatatattcctagctacaaaatttttaattctcagtatttcttagataaattcagtttttattctcagttattcagtgacttgtttaaacagtggaattctagagtcacacttcctaaaatatgcatttttgttttcacttttagatatgatacggaaat

SEQ ID NO: 212 - DNA, 1355 bp, Homo sapiens
tcaactaaaatacaggcaagtttaaagcattacattacgtaatcatatacggcagtatggttaaggtttctgtgtagtctgtgacttccatgtcaaaatgttgcacaagccagttgtcagtgacagttgccatcccacactgctgttctcctgtcatccctagcccccatttaagagagatcacacattcatgcattgcttgcttccctctttccccaccccctccttaacctcttgatgtatgagaagaatatgagttactaatttgatccactatttggggattgctaataaagcatttttgcattttattttttgctttttaaaaataattgatattttaacaatatgaaacaatatattcctagctacaaaatttttaattctcagtatttcttagataaattcagtttttattctcagttattcagtgacttgtttaaacagtggaattctagagtcacacttcctaaaatatgcatttttgttttcacttttagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaaggtaaattaatttgcactcttggtaaaaatcagtcattgattcagttaaattctagaagttttacatttaaattttaaatgcttactaaggatgctcaatttcttagatgtactgataattttagtataaaaagcatattcttcagacagttaaagtttttgtgcagtttttgggaggtccagagatctttcttgagcttaaataatgcatttccaattaaaaagcaaaataaatttgcaccatttgattttggtatctgtagcttgctgccctcttgttctcatagctttgctttgatcagatccctattccactctggattagagaattacattttagtacttttcaaatatgtaatagatacactttttatctctatgtagattttaaactacataacaggactctttgtcatattgaatggtctgcagtattgctatctgaaattaccgataatattgtacattcagattcacttaagaggtaaccttgcagagaat

SEQ ID NO: 213 - DNA, 1156 bp, Homo sapiens
gcttaacaccatgccaggtaccttagtaagtgttcgatgaatatttgctttttgtattagccataatcattctcaggctgctttgtcatttacttgttccacaaattcttagcttccaaaattttggtgatacctcatttcctattctctctagttgcctttgtccatgtagattttttgaggaagcttgggtaaataagtgtattttaaactattatgtttaaatcgaagttccttttatctgttttctaatagaaacatttaaatagcattaagaacttgtagcagtataaacaatatgtttgagaagtactatattgtgaaaatattttcacttttatacagttttttacttatttactgtcttactaatcttcctaagactttttaaagtgaatatttttaaggcagttctagaagaatgaaaactcttatgatatctgtaatagaattgaatacatatttaactactaaatcaatatatttattaatttgtccagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacaggtatgatgtattcttgaaacttaccatatatttctttcttttgatacaattaatttgtttgtttgtttgagatggagtttcggtctcttgcccaggctggagtgcaatggcgtgatcttggttcactgcagcctccacctcccgggttcaagtgattctcctgcctcagcctctcaagtagctgagccaccacacctggctaattttgtatttttggtagagaaggggtttcatcatgttggtcaggctgatctcgaactcctgacctcaggtgatccactaatctcagcctcccaaagttctgggattacagatgtgagccactgtgcctggcctgatacaattaacttgaatgttatatatgtgacttttttggtgtgtgtaacacattattacagtggatggagaagacatcatctggattatacatatttcgcaatgaaagagaggaagaaaaggaagcagcaaaatatgtggaggcccaacaaaagagactagaa

SEQ ID NO: 214 - DNA, 1145 bp, Homo sapiens
cctgaccctagaccttttcctctgcccttatcatcgcttttcagtgatggaggaaatgttggttgtgttgatgtaattattcaaagagcataccctatacaggtatgatgtattcttgaaacttaccatatatttctttcttttgatacaattaatttgtttgtttgtttgagatggagtttcggtctcttgcccaggctggagtgcaatggcgtgatcttggttcactgcagcctccacctcccgggttcaagtgattctcctgcctcagcctctcaagtagctgagccaccacacctggctaattttgtatttttggtagagaaggggtttcatcatgttggtcaggctgatctcgaactcctgacctcaggtgatccactaatctcagcctcccaaagttctgggattacagatgtgagccactgtgcctggcctgatacaattaacttgaatgttatatatgtgacttttttggtgtgtgtaacacattattacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaaggtaaaattagttatatggtacacattgttatttctaatatgagaacaaagtcttagagactttgaatttaacatttttaatgagtaaattgtttttattttgagtagtaaattgactttattttttagtatctagggtattcttttttggtgttagacaaagaatagcaacaagggacagaaatatcaggtctaagccatttgtaatatttttcctgaattcttacctatatgatgtggcttttgcatttttgtcatggtagttattagctttcatgtgttattatgcctggaactaggacctattgtggtgtcaattttaatattaaaaatcatggtgttttgatgtttatatgacataaattttattttttcgtatctcccttttgttgttgctgaagattttatgtttttctgcatttcctcatgatttatatagatgtaacatgttctataggacatgtaatttacatgtcctatagaactataagttacatgtcc

SEQ ID NO: 215 - DNA, 1122 bp, Homo sapiens
actctgtatgactttttttttttttaaacatgagtacactggtttcaaaatttcctggaaaacttatagcaggccaggtgtcatgggtcacatctgtaatcccaacagtttgggagtccaaggtggtggatcacttgaggtcaggagtttgagaccagcctggccaatatggtgaaactccgtctctaccaaaaatgcaaaaattaaccgggcatgttggatgtgcctctaatcccagctactcgggaggctgaggcaggagaaccacttgaacccaggagacagaggttgcaatgagccgagatcacaccactgcactcccagattgggtgacagagtgagaccctgtctcaaaaaaaaaaaaaagaaaaaacttttagcagttatatagtttcttatctttaaatctcccttctttgggtgttttatgcttggttctttagttttagttgcttttgaatttacagtttagtgaattaataatccttttgttttcttagaaaacacaacaaaaccatatttaccatcacgtgcactaacaagacagcaagttcgtgctttgcaagatggtgcagagctttatgaagcagtgaagaatgcagcagacccagcttaccttgaggtgagagagtaagaggacatataatgaggcttgatgattattcaaggtgagaagctgttttagactctctggccatcacaggaaggagtatgttgaaatgctgcatttctcaaaagggatgtgtacatttctgggattttcagtgatgtgccagacgagtgtggtggtatgttttcaactatataccgagtagaggatgggagggttctagaattttatatattaattaaatttggtttaaaatgcaggcaaaacttgttttatttttgtccctcctgtactctgaagcaaaaaaacttttttatttttaagataaaacaaatatcttcaaagtaatggcttagtttccatgttcttagctgtttctcaagtccttcctggagtgtacttgataatcctctaccctaagggtacttgggtagaaatgtttccgaagcactaaactgttagaagtagcataggctttagaatcgtggcactctcattttattagcaaagta

SEQ ID NO: 216 - DNA, 1199 bp, Homo sapiens
gtatctactatttcaaagttaatggaattatactcctggggctaagaatgagggttctagggccaacctctactacctatgtggcttgtgcaaattagttgtcccctttgtgcctcagttttacctacaacacagaaacaatgatattacctaccccatggactgttgtgaagattaaatgaattagtacatttactacacatagatctatttctcaaaataatgagcattcagatattagccatctgtaatgtagttggtgatgattatgattattagagtacatttataattggaggatcatttttgccgtagggaaatagaattattaatagtttgaggcacctgagaatattatgtgagaaactgattacattaaccacacccttaagatgagctctaattttgttgtatttgtcctgtttaaagccatctagttacaatagatggaacttttttgttctgattgctttttattccaatatcttaaatggtcacagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagttttgataagtgcttgttagtttatggaatctccatatgttgaatttttgttttgttttctgtaggtttcagat

SEQ ID NO: 217 - DNA, 1164 bp, Homo sapiens
ctagttacaatagatggaacttttttgttctgattgctttttattccaatatcttaaatggtcacagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagttttgataagtgcttgttagtttatggaatctccatatgttgaatttttgttttgttttctgtaggtttcagatgaaattttatttcagatttaccagccacgggagccccttcacttcagcaaatttttagatccagactttcagccatcttgttctgaggtggacctaataggatttgtcgtttctgttgtgaaaaaaacaggtaatgcacaatatagttaattttttttattgattcttttaaaaaacattgtcttttaaaatctcttatgattagttggagctaccagttggcaaatttgctagctaactagtgatctgaaagtaagcctctttgaacctctgatttttcatgaaaagcaattctctcaattctatattatttcaagggtaacaagttacatcctagtctgtgtacttaattttatagaaattgtccttaattttattttctgcaatttatgttttct

SEQ ID NO: 218 - DNA, 1139 bp, Homo sapiens
aagattcaggtaagtatgtaaatgctttgtttttatcagttttattaacttaaaaaatgaccttactaacaaaatgattataaatccagataaagtataaagttagtttatatcagagaagcaaaatccactactaatgcccacaaagagataatataaaagaggatctgtatttattttgaaacaaacatttaaatgataatcacttcttccattgcatctttctcatctttctccaaacagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtacaaacctttcattgtaatttttcagttttgataagtgcttgttagtttatggaatctccatatgttgaatttttgttttgttttctgtaggtttcagatgaaattttatttcagatttaccagccacgggagccccttcacttcagcaaatttttagatccagactttcagccatcttgttctgaggtggacctaataggatttgtcgtttctgttgtgaaaaaaacaggtaatgcacaatatagttaattttttttattgattcttttaaaaaacattgtcttttaaaatctcttatgattagttggagctaccagttggcaaatttgctagctaactagtgatctgaaagtaagcctctttgaacctctgatttttcatgaaaagcaattctctcaattctatattatttcaagggtaacaagttacatcctagtctgtgtacttaattttatagaaattgtccttaattttattttctgcaatttatgttttcttactatttctggtgtatgtgtttatcccattgtgatgttatattggtgtcctcaatttatttccttagccatacactctacttttcattgtacagggctatttattatctcagagtcaagcttttttttttttttttttttccccgagatggagtctcactctgttgcccaggctggagtgcagtggcgctatctcagcccactgcaagttctgcctcccaggttcacacca

SEQ ID NO: 219 - DNA, 1245 bp, Homo sapiens
cctgtatatgagctaataaaagttgcttccaatattttataattataatgtttcagtgagtaaccttgttcataggtgttttcatgaactttatgttcatgtgtattttactattattagaggtctatcttcagagaggagtacaagaaatgggattactgggtgcaaaggtaaatggatatgtgtctttgctaggtattgccaaatttatctccagaaatcttgcacaaatctgtactcctgttagcaatgtgtgcgtatacctgcttccacatgacctcagtaaaagaatgtgttgtcatattggtattgaaattttagcactgtaagcaacaggtcattttggaaaacctgagctttcgccaaattcagctattttgatttgcttttattattagcatataccaaaataaataggcatattagagtttcctttcttgcatcttaaaattcatctaacacatctataataacattcttttcttttttttccattctaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgaggtaaggttacttttcagcatcaccacacattttggtatttttctattttgacagtccagtatcaaggaaatagcttttatacaaattggatagttgaggtagtatgtgaggtaaagtttaatcatatattaattgcccatgaacctcaggagatgggggaatggggaaatgacagcaactagaaagagaagaatgacttgaagggaaatgagttaggagaaattgtgagaaggatgttcagaaatgcagactttgtaagcaaactggaaattggttacaagaataatatgagttatctgtggtttgcagcagtcagcagtgtgattagttaataatatagagactacaggtttacatttaaactccatatctagtgttttatacagattatatttctttgacttgatttaatcccagataagagacactgatattattttccctagatcatgtatgcattttctgcttaaatctatatatacattatataatattagctg

SEQ ID NO: 220 - DNA, 1147 bp, Homo sapiens
atatttgaccagttgtgatttctcaagcaacagtttcatgtagtttaacctataaatcatttcaattaattcttggaacagacgtgaggtaggtgaggcaattctttcttttctctaaccaaagaagtacctttatagatgtgagatgattcccagctattaagtagtaaatagagctaggacttgagccccaatcttccagcttcaatccagatcatatgacagcttgctgattaaactagatgacagagaagatctctttccttcagatacacatactttttctctgttcccctctccctatcagctagattcccctaaatcactgatactggttttgtaattttgcatcggcatgtttgacaattggtatcacatttagggtttttcattcttttttggtccaaacttttcatttctgcttttaaaggaaatacttttggaaacataaatatgtgggtttgcaatttataaagcagcttttccacttattttcttagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctggtaagttaatgtaaactcaaggaatattataagaagtatatatggaggccatcgtatattctgttgtatacctagtaaacatggtaaaatgtaattaaacttaattagaaaatgtggttgttatgtggctcctgtaagtatagttatttagaaattttatttattgaagcaagatatgaaactctgggtgcacactttccaaacaggtgctttcatttacatgtgattgaaaagtgttttttgtcatttatttcactgttccatacaattagggttgtttctaagctgtttgtaagctgtttctaagctatttaagtggttaaatcacagtagatgcaaatcaagctaaagtctttaacattggctaatggctgattcttaaatagctaatacttgctaagggtatctatattaactcatttaatcctcataacaaccctatgagataaaacctaagtcctcacttaacattgtcaataggtttttggaaactgatttta

SEQ ID NO: 221 - DNA, 2511 bp, Homo sapiens
acagtttccgagaacctatcaattatgttaagtgaggacttgactctattatcctgattttgtagatgaggagactgtggcatagagagaggttaagcaattgcctaataaggtcacaaagctagaaaagtaggtattagaacccagatagtgtgtgttctcaagatggctttaaaatatttatctttgtttaatctgttaataataaaaaacaaaagattaaagcataagtgacgtcccctacctccttttttatcttttactgtgattattcttcatcttccttccttttcatgtcattttatatgttcttatgtaaaattactttcatctagaataggaataatgtgaactgaaatcacctaacctattaggagttaggggagggagactgtgtgtaatatttgcgtgcttaaatattttcaatgaaaagttactttgatttagttttttatgttactacataattatgataggctacgttttcatttttttatcagatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgattctgcctgctttatttttagcgctatcacaggacccagagcctatgcccttttaaacttaccacaaaagcagaagattaattcaatttaagatgatactctcatttgttacgtcctttttttttttttttggagatggagtcttgctttgtcgcccatgctggagtgcagtggcatgatcctggctcactgcagcctccacttcccgggttcacgtaattctcccacctcaagcctccctagtagctgggattacagggacgcaccaccatgcccagctaatttttgcatttttagtagagactgggttttaccatgttggccaagctggtctcaaactcctgatgtcaggtgatccatctgcctcagcctcccaaagtgctgggattataggcgtgagccactgtgcccggccaatatttgttactttcttaggtttaatagagaaaagggataaaacatttctaactgggagttaattgcatggagaaggtcttaaatc

SEQ ID NO: 222 - DNA, 1500 bp, Homo sapiens
aatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgattctgcctgctttatttttagcgctatcacaggacccagagcctatgcccttttaaacttaccacaaaagcagaagattaattcaatttaagatgatactctcatttgttacgtcctttttttttttttttggagatggagtcttgctttgtcgcccatgctggagtgcagtggcatgatcctggctcactgcagcctccacttcccgggttcacgtaattctcccacctcaagcctccctagtagctgggattacagggacgcaccaccatgcccagctaatttttgcatttttagtagagactgggttttaccatgttggccaagctggtctcaaactcctgatgtcaggtgatccatctgcctcagcctcccaaagtgctgggattataggcgtgagccactgtgcccggccaatatttgttactttcttaggtttaatagagaaaagggataaaacatttctaactgggagttaattgcatggagaaggtcttaaatcagatgttttaatgccttaaatgtctgtataatatcatgttttcaaatctaattataaatacgtttaaagccaagaataaatcttttaaaaaattgacttgtttccttccataactctgagccatgatttttctgttctgtaaaaagcattaacaaaattgtctattttgctactccctgtaacttaagtattctgcaagtcttattaatgagacttgttttgtttctaaaacagtttggttttcacatcctaattttgcagtgatccactctagaacaaggaataaaacttgggtttcaaacaggagaacagaaaaaattacaagaatttaaccttttcttttttgaatccttggtacaactgctattgtctgttctcatgtagaacacccattatgttgatagatatgtaatgcgcacacttttttataaattataaataacatccaagctacatgaaacaaaatatgaagcttgagtatatgtgcatattatcccctc

SEQ ID NO: 223 - DNA, 8166 bp, Homo sapiens
gctattgggcgctgggagtcgagggggcgggaggcgggaattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaagtggctcttactcatttacatttagggaacgatggtgacgtggtttggctatgtccccagccagatctcatcttgaattgtagttcccataatcccgacgtgttgtgggaaggacccagtgggaggtaattgaatcgtgggggcggttaccctcatgcggttctcgtgatactgagttcttatgagacctgatgattttataaggagcttttccctgcttcactctcattcttctctcctgctgccctgtgaaaagttgccttccgccatgattgtaagtttcttgaggcctcctcagtcatgcagaactgtgagtcaattaaacctctttcctttataaattacccagtcttgggtatgactttattagcagcatgagaacagactgacacagatggtatatgtgcataataacttggaaagctagatatttattttcgcaatgctacaattaaaacattttgaggacttttaaaattacctttagggccaggcgcggtggctcacgcctgtaatcccagcactttgggaggccgaggcgggcggatcacgaggtcaggagatcgagaccatcctggttaacacggtgaaaccccgtctctactaaaaatacaaaaaattagccaggcgtggtggcgggcgcctgtagtcccagctactcaggaggctgaggcaggagaatggcgtgaacccgggaggtggagcttgcagtgagccgagattgcgccactgcactccagcctgggcgacagagcgggactccgtctcaaaaaaaaaaaaaaaaagaaattacctttagaattggtaaactacatgagaaaattaagcatattattcatatcttagtgttattacccaacttcatctccaatactttcccctttccctagctagatatgtttttgtttgtttgttttagacagtcttgctctgtcgctcaggctggagtgcaaaggcacgatcttggctcactgcaacctctgcctcgcaggttaaagcgattctcatgtctcagcctcctgcgtagctgggattacaggtgtacaccactgcacccagctaatttttttttttttttttttttaagtatcgacagggtttcaccatgttggccaggctggtctcaaactcctgacctcaagtgatctgcccacctcggcctcccaaagtgttgggattacaggcgtgagccaccatgcctggcctagatattttttattctttccaaaatttaattctccctgaagttaaaaattttcattactgagaatgtacatagagatgtgtcacaaccctttagtaattccaaaaggtgtttcaaaaattttatacaatgataatcactgttgaaacaggtgtatattctcctcagatcatgactgaccaagatgatattccaagaagtaaactactggcctttatagagtaggatgtaggccattttcattactgataacatacttttaaaagaaatgtttacagatttaaataagttaaaacatctaaatgcttttaaaagagcacctggcacattgcaagttattcattattaattagtagatgaatcatatatctggagtgcacccttgctctatatgaaagcttccctaactatagatatataggtgatagactgacaataaagatttgaggaaagaaaaattatttggctggcttattttttaagcttttgagatgtataaggtagagattgtttatcaaataatttatgtgacacattcaatgcatatgaaataattatctaatactgaatttattcaaggactgaaagtatatagagcacacaggctgcaaaccaggaaaactaccagttagagacagggctttattcttggaataaaggtacaatgtaaagagtagatgtttcatgacttgattaaattatttaaaactgtctagaattgtgttataaaactattactatgtttctatgcacttagttattacatgggtttaaatttggcactgtttctaagtttctataaggctttgttgttaagatctttctattcaaaacattaattttaacaaaaagcttttccccgttatttttctgcaa

SEQ ID NO: 224 - DNA, 8166 bp, Homo sapiens; identical to SEQ ID NO: 223

SEQ ID NO: 225 - DNA, 1500 bp, Homo sapiens
actgggaagttcataatttttttcagtattaccaatagatattattgtcaattgcggtatcacattttctttcgtttagattacgtctttaggataaatatctggagctcagattactaggtcaaagggtagagtttatttttatgactacaagttttgtcatttttggtaagatatatcacaattgacaatgaggcaaacaaatcaactagccccctcctgctctttcttcccagcaaactccttccccaaactagttacttgaatttgagaaacagtatgaggttttgccttttggagacattattatttgagccaagtttaggttatacagattttttaaaaaaataacatgatttggcaagatcatgatgaacctccttttctttgagtaaattaaagtactactggcaaataataaactggtcttaggagggatggaaggcggataagccttaatggaagtagaagtgatctgatactggagaccctgagagcttgtctctggcttattttagcatccgggaaagccttgaatattatgaaagatagattgtagcccgatgtcacagagccttcttacttaagtttggctcagcagtctggcaattcccgcctgagtcttcgctatcctggctactgcaaagctgggtaatttaaattgagtggcactgataaatgctcaaagaacttggcaaagcttaaagatacttcctttccgctggtctacggacgtgaagaatgagacttccagtttccaaggaatttgctgcatagactctatcgccggtttcaaaagtcaaactgagacgactttctactttaaacaaacactagggatttgctggagtggcgacaaccttccgccgcgtaccttgagcccttgtttttttttttttttttcggagacttccattggatgccgaagttctcgccccctcacctcgcaccgggactggttgattcctggccttggcgggtgattggtcgagctcgctgggctattgggcgctgggagtcgagggggcgggaggcgggaattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacaggcaagtcggagggaagtccacggaaagggcttgagttcttctgcacagcctgcgggcccatgggtggtgactggatcaccagggtctcggggatctcaactggctgggggaggagggagatacggggcagaaaacctgaggagggagcctatccttacctcctttgagcgcaggcctgttcttagcccgggcgctgcgttaattcttggcgggaggcagagggg

SEQ ID NO: 226 - DNA, 1276 bp, Homo sapiens
gtctctggcttattttagcatccgggaaagccttgaatattatgaaagatagattgtagcccgatgtcacagagccttcttacttaagtttggctcagcagtctggcaattcccgcctgagtcttcgctatcctggctactgcaaagctgggtaatttaaattgagtggcactgataaatgctcaaagaacttggcaaagcttaaagatacttcctttccgctggtctacggacgtgaagaatgagacttccagtttccaaggaatttgctgcatagactctatcgccggtttcaaaagtcaaactgagacgactttctactttaaacaaacactagggatttgctggagtggcgacaaccttccgccgcgtaccttgagcccttgtttttttttttttttttcggagacttccattggatgccgaagttctcgccccctcacctcgcaccgggactggttgattcctggccttggcgggtgattggtcgagctcgctgggctattgggcgctgggagtcgagggggcgggaggcgggaattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacaggcaagtcggagggaagtccacggaaagggcttgagttcttctgcacagcctgcgggcccatgggtggtgactggatcaccagggtctcggggatctcaactggctgggggaggagggagatacggggcagaaaacctgaggagggagcctatccttacctcctttgagcgcaggcctgttcttagcccgggcgctgcgttaattcttggcgggaggcagaggggtgtgtttatcctttatgcaatgtttgggggaagctaccccattttgacactattgttgccacagccggggtacaggacgggctgatttctagattatatctgagtaactaggccagcgttgagttgttgattcatattaagaggttagattccaccatacctcattctcagagctttacagatagaatcgcaaaatgttagagctggaaaataccctagaataatggttcttcttttggagcacacaagcagtggtgaatgttattattggcttca

SEQ ID NO: 227 - DNA, 1123 bp, Homo sapiens
tcttctaactggaggactgcagaaaggggtaacacaaaggggaagaactggagaaagagtgatgctacggagttgtagagagagaggcctcaggaacttatttgtttctgtaggttgattacatctgatctaactgttacaagagctcatgtttaatctggtatgtactttatcatatttgcacattatttcacttaatcattaccacaatcctatggggtacatgcagtcactgtggcttagagaaggtaactaactttcccgaagtcacacaactaatacctggcagagtgaaggatacaaatctagatttgttagactctaagacatgctcttgaccgctgtgatttataagactaggaaattattttgtttccatttgttttgtttatacttttattaattccagtttctgtttccagatttctcccttagttttggttctctggttttctttgtaaggcgtgtctcaatatttgacattttcatttctgttgtagttaggaatctgaaataaacaggaaagcactatgtcttcaatgtggtctgaatatacaattggtggggtgaagatttactttccttataaagcttacccgtcacagcttgctatgatgaattctgtaagtatttttcagcagttaagtttttattaagatatagatacttatgacccataaagtacattgagtatttgactgcattcatattctcagtaaatggagaatattttctgggttcacttggaagaatatctaacctctgggaaactactgattgcagctaaactgtatatatctgtggttaaggcaaagaagaacattctgaaaaatgttctcagctcatttggaatttctatacttttaatgaaaaactgctatacttttaagtaaaaacagagtatttactatcttttacacagaatactatttttctcaccattgttttgtttggatcatgtagaaaattaatatacaaatttgagtaaaccagctttccagttttgttacagctattttgccatatgtacttcatatcttatttactggtaacaagattattagtatcctgaatttgttcttttcctttcctagccatgtttttatacttttattacatatat

SEQ ID NO: 228 - DNA, 1112 bp, Homo sapiens
gattacaagcgtggctgctgctgtgaactttcttatgcatgtttccttgtgttcatgtgggaaaggttttgggtgtacacatagaactggacttgctggagctgggcatcttcactttataagaaattgtttatttctctaccaagtagttgtaacaatttgtactctcactagcagtatccttcattaagttttcatcaaatatattgataggtagtaatgtattctggttttacagaaatcattgatgcttgcataattctggcacagattcctcttttcatttcttctcttgtgcttgatattttagtaagataatcttagggagaggtgtaaaggaatacagtttggatttaactaaatatgagttccttctgctattgttgtgttccctggagtgcaatctcacttttccttgctgttctatttaaacttcagatggagagagacctttataaagttaatatgtttattattttcattggtttctgtgttcatagattctcagaggattaaacagcaagcaacattgtttgttggagagtcccacaggaagtggaaaaagcttagccttactttgttctgctttagcatggcaacaatctcttagtggtaagtagttgcttgatatcttcaggttacttactgggatctgagaaaatataatacagtattctttatccagactggttcagccatgctgtcgctaacttaaatatttgtttaaagatgtttctttgaaataagttataaatcttccaaaagagtttcaatatagcaaaatatgtttaattaatgctaaaatagtattgaacataatttagtcttttgatgagtcggaaagtacataaagacttggcagcctgggcagcatggtgataccccatctctacaaaaattgacaatcaattagccaggcatggtgatgtacacttgtagtcccagctacttgggagactgaggtggtaggatcgcttgagcccaggaggtcgaggttgcagagagctgtgattgtgcactccagcctgggtgaaagaaaacaaacaaacaaagttttggatgcttagagttattataaaaataattagatgataatttgtatgtaaaagatg

SEQ ID NO: 229 - DNA, 1174 bp, Homo sapiens
tggtttttgaaacagagtcttgctctgtcgcctaggctggagtgcagtggcatgacctctgctcattgctacctctgcctcccaggttcaagcgattctcctgcctcagcctcctgagtaggtggtattacaggcgtgcactaccacgcctggctaatttttgtatttttagtagagacagggttttaccatattggccaggctggtctcaaactcctgacttcaattgatgtgcctgcctcggcctcccaaagtgctaggataacaggcgtgagccactgtgtccaaccaaatgtttttggcttatttctctcctgtcctaatttgatgctgcagataaagtgaccagcttgtccaggtttgccaggtaccttcctggtgttagccctaaaaatcttttatcttaggaaacctcccaatcctgggtgaactgggctgtagagaatgattgatgtttatttaattagatatattataaatagatgttctttcatttttagggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaaggtaatttatattttgcctgggtcagttgatatctgtaataagagtcttaattattactgttataagccctaatttatataagtttggttagcataactgattatatatctctatctagtttctctggaatgattttaaaatagcacagagtggtcaaaaatccatagacgtttttaaattcttggtttgacttttaatttattgagacattttgttgtcctaaataattttttaaggaaggcaaggcaaaataaatgattttccaaaattgatgttatttgtagccattattgttaattatatgttagaattctataaaacaatgtttgtatcctaagacgaaatctaattagcctcattgattcattcttgataagtttgcctggccttctgaggccagtatcctacataagtatcaggtatgtttatgtgtgatctttaaataatttttactaattttagagaaatacattaagagtaacataagattattaataata

SEQ ID NO: 230 - DNA, 1128 bp, Homo sapiens
tgggataattaatgttatttggtgattaagaggtcctggatgaccttgagaaggagctttcaggattatgggattaaaagacagattatatgagcttgattctataatcaatggttttgctctaaagaacgtggagaaacttagtagggaagaaacgttgatactgtaaagaaagatttttacagacatgaaatatattttcttcagagatccttgcagttatacattttaaatcatgttattgggagtagtctacaagtacataaggcgatttaaaaaatcaaattggacttttcctattgaaagcatgtttctcagaatctttggtaaagtaaactgaatggtagagaagtactttttaaacatgtttaagtttcatgttttagattatggtatgaaatttctagaaataagccttacatcctggttccagttttcttctagaaaaattgcctacctgtaagttatttatgctgttttttttaaattacttatataagactcccctgaaaaaaccactctggctgcaaagttatctgctaagaaacaggcatccatatacagagatgaaaatgatgattttcaagtagagaagaaaagaattcgacccttagaaactacacagcaggtaaacagagtttattggcagtaaataacccagttagttacagctgaacatggtagtcaagtatcatgtttttaatgcacttgtggagattagttgggtcatgtgacagccataaattaataatttgttgtaatttcattttgtagagttacttgttacaaaggagtttattatagcagattattcacagtaacatgtcgttcaagtgaaactgcatggtgtttcttatatatgaggaatttgatagtaaaatatttacttaaggcatatcttagtgatatactactttgtactttttaactcctccattgtttttatcttaaaatagcatttccttttggctaaaatacctttgatatgattattcatgttatggatattttggaattgatagttttaatgtaatgacaagatgtattcttactgagtttttaagattgatacatgataaaatatgtatatttatttctaaaaattactaaaaggcttgaattaccaga

SEQ ID NO: 231 - DNA, 1120 bp, Homo sapiens
caacttggtttatcaaatatctagtaagtaacagtgataatagtaatcgagtaatttattccatcctgtaggaaatcatgactgtttacattaaaagttttattctgagttcttttcaatgtagaattatgcttaaattttgatttacttttattttccaattagatataagattggactttccaatattgctatatttgatgtccatatgatgggactattttatgagaagttcattttacaatactctaattttgatacatcactaattaaagatagtttggctaagattcatgagtcactactatgttctatttcctttaagtgttgtaatgaggtgcttatttgcatttttaaaatttcttttattattgcctgttagaaatagtctttttttggatgcaggaaaaaaatacatagagctgttttggcctttgagaacaactagccagttaaacttctagttcaccttaaacttcattttggttctgtgtttacagattagaaaacgtcattgctttggaacagaagtacacaatttggatgcaaaagttgattcaggaaagactgtaaaactcaactctccactggaaaagataaactccttttcgccacagaaagtatgtattaatgccattgttcagttttaaagaaggaagatatggaattttctaaaccaatttttgacaaaagaggaacaatagtataatacaaaggacagtagcaacccactcagaagtcctcaatgctgtcacatctctgttactaatgtgtgagatggcaaagcctattctctctatgcctcgtttccttatttataaaataagagaattggactagagagagatctgaaagtcatttttttctgttctgtattttaatgtttgtaaattctccaactccttacagttctttcaggattcttagggcaacagttctcaaggagtagtccaaggagttctagatattgagatttttttggggagtgatctgtgaggtgaaaattatttttgtaataatattaagatgttgtaggccaggcgtggtggctcacgcctgtaatcccagcactttgggaggccaaggcgggtggatcacttgagttcacgagtttgaaacc

SEQ ID NO: 232 - DNA, 1291 bp, Homo sapiens
atcctttagattcaacttgataattctattcttttgtaaactatatttaaaagtgcttcaaaagcattggtgtattaaggaatatttgaatgaactatgctgtgaacaaaactattaactctaaactataatatcacaagttcgtatgaagcctaagaaaaaattaaaattgttcctactttgttttatcatttttataatttatgaaagaggagagttaaaatgtactcaaaacatttggaattggagagttagagtggtatgttggaaagaatgcaaatttggaaatatcatttataacttttaaaagaaagaatgaggaccaattttaaattgtagttttttctttaatggcaagttttagatactataatttcttgttatttctctttatttgaccattgtgattcattacttacaggttctgattccatgtgaggtttgataacgttttttatggtagtttagatattagttatcgtttctttcctttcttacagccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacgtgagtaaagttattttgtgttagagaaaaaataaggctgaaaatatttaaattactcagtatgtgttttatatgtacattttagtgataatcaacttcggaaaatcaaattaactgctagtattgatatcttttaaaaaacaattttcctgtaataaaatctttagtcaagttttaaagtatgggatttggtcttaaagcttgggatatttaattccttgaaattaatttctgttgtagtcagacatcttagtttcttcttttaaatcctgctaccaaaaatagtcaaacttggatgatatcatatgaggagatagaagtgtttaaatggtttagtctaattagatctaattaatatactttatatacttaaaaacttcaaaagcagatagtttatttaggctgtctgggcaaagtttgaattttcttaattgaatgagaaatataatgattatcccacctcataattctgataaatacaaacccctcttttaaaagtt

SEQ ID NO: 233 - DNA, 1222 bp, Homo sapiens
tacttaccttccttccttcttatttatatttgaataagaaatactatcacatggctcaaagttgaaaaggtacaaaagggtctacagagaaaaatctctcactcctgtgcccagtcacttaattctcatccttggaagcaaccagtgataccattgttttgtgaatcctttcagaagtatttcatgcctaacatcagtttaatcagaaaaaaaaaggcataacaaacatatttaaaagaaatttttttcaagttaatttagggtatttggagctcttccgatttggacttctatctaagtctgagtcaaccagacttcgttgtgattgtagctatggtattgtctcaaaaaagacaaaaaattagccaggtgtggtggcgtagccagtaaaatcttagccttgtggctttaatgatgttcctcaaattctgagataagcttattttattccttctatgctaatattggttcacatttcagttatgcatatttgtttctagggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtgtgagtatatgtgtaaaaatgagaaccttcttcctactcatggagatgtaaatgttgaatgtaaaagcttttagatgttttaattttttttgctttaatttatgtaaataaatttgtgtaaacatattagagtactgaaaacatatcctaacatgggttaaaatcaacccactcattttaatttccaaaataacaagcagttttaaggaacatagtgactgaagtgggattacagcaggatttctctttgcatttatgaatattcaaaaagaattatttagaaacatttctctgaaaaaactatgttttgaagaacttatgtgggggaataaaattatgccttgtgagctttgagaagtgaacttcagataatggcatttgtgtttgtttgcctggttctttttagagacatgcaattgttaacagcataagacaaaaagtgaataatttggcatagtcaattgttattcctgtcttcagatctgactgcacaattcatc

SEQ ID NO: 234 - DNA, 1200 bp, Homo sapiens
atatatattatgttagtattttaagagtcattttaatcttgtattgttattttacttttaaaggttttatgcttttaatcttgtattgttattttacttttaaaggtcttatgcttttaatcttatattgttattttatttttaaaggtcttataattagtttgtaaaattatgttggaaacactttcatagtgggattttatacctttctgtgtagcctgtggtaccttgatccagactcactgacatatttttgttgctgtcgataggtttgcaaagtattttaagagtaaaaaaatggcaaacacaataatgtagagctgatatttggttggccatagtgcttcagaagttttatttaagacctagaatctctgttgcttatgtaattgcatttgcaatattggcctatagtgtgaattttaaaatgaaatatcttgcctgctgttgttaaatctattttgccaaatgttttacaagaaaattcttttatcttatagatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaagtaagaagatttgtctattagtgtatttgtgctgcctttatatgaaaaatatgtttgattatgccagagtatttaaagttagtaaactttggttaactaggcttcttgggaaatgaattgttccttgccagttaagctttaaaaacaaggctagtccaaccttttgtcttgttcacaagaatataatgaacataagtgatttttaaaaatgaataattgtgaatcttattcctaatttggcaggataacataatagccccgaaggatgtgtctaggatattgaaccagaaactaaacgtgcttttaattaatatattttaaaattctggatcatggctttaatttattgctttattctccaatttaaataggattctagtttcatgggttttaattaatcaagatttcagtactctaaaataatatatttagtactagctttatgacaatttacactaatttttcttttattagacattaagttgttgatctagaatctt

SEQ ID NO: 235 - DNA, 1133 bp, Homo sapiens
ttattttcactacccagaacaatgtctggaataaaataggcattcaaacacttaatgtatgaatgtgtatatatatcaatgaatgtatttatatattttctagtaattctcttttttgtgttaatatgtaacactttaatttctttattaggttgttttgcatttccttttatatatatttgggataagtacctaagacctggctctcagttgaagagacattagctaagtaaagcaatgtgaatccacaaaacaagtgggaaatcatatgcatgtttgtttcttctgaataaaagctttcttttcagttatataaagtttattttgcaatatgagacatgaatgctttttaaaaggtgtcttaattaatccacattcatgtcctaagaatgtcaagatatacagatcaacgcatgacaataatgatgattctcttgttctgctgaaatagtgtgtgtaaggatgatactggttgacacaattgttttattttatttcagttggttagaagcaaacgctgaatatcttgtagaaagagattatgaatcagcttgtaaaatatggagtggaaatgaaatgctcttaactttacacaaaatgggtatcaccactgctacttttcccattttgcaggtaagatattttttctacctgtgaaacgtatttagtgaattagaagtgatttagtcgtgactaaatccagattaaatctagtgagtaacccagaattgttaaatatagcaatttaattttttaaaaattttattatctaaatttgataatctttaagtgatggcatgggtaaattgtgggtgaaaatatagcattatttagtttgaaggaaattagtctttaaagggattaattgctttgtttaaagctaaaaggagtcaatatttttaggttgtagacttacttagtcaattgtaaaagttaaaattttagaaaataaaaagaggagaaattcctattttgttcatcttaatttagaaattataaacctgatattcatggagagatcatgagtaggctttggaagactatgaaacttatgaagctatatgcaaaattttatgagcgtatccttttgtacatttttctaaatagaggctgcataaatttcattatatttt

SEQ ID NO: 236 - DNA, 1155 bp, Homo sapiens
ctgggtaacttacaaagaaaggaggtttatttggttcacagttctgcagcttgtacgaagcatggctccagcatctaattttgaggaccttagcctgcttccactgatggcaaaaggtgaaggggagctggtttgtacagatcatatggcaagagaagaagcgagagagagaagggagggaggtgtcaggctctttctaacaaccagctctcgtgggaactaacagagcactaactcaccccctctctacttagggagggcgttaatctattcatgaggtatctacccccatggtcccaaacctcctgatatgccccacttccattactggggatgaaatttcaatatcagatttggagaagtcagactatcaaactatagcaattctgttcacctaaaatttcaatgcatgttttgttgggtttcattgtatttttgagaagtttctttttccaattccctcccaacccctctatacttaatatggtaatttcttatagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcaggtaagtgaagataactagtatgtattttccttttaaaaatagcctaatttggatgctagcatgtgtttaatacatacctattttgggtgagtaaataggagaattgaaaacaagtgttatagatattattatatatttgctcttattgacacagacttagaggaattgaaattagtctgatgcttttttgagacagggacttctctgtcacccaggctgaagtgcagttgcatgatcacagctcactgcaactttgacctcctgggcttaagcaatcctcccacctgtttcctgagtagctgggattacaggtgtgcaacacccacacccagctaattttttaatttttattttttttgtagagatgagatctcactatgttgatcaggatggtcttgaactcctggcctcaagtgatcctcccacctcagcctcccaaagtgctaggattgtaagtgtgagcccatgcctggccaaaattagtcttttatattaatgaa

SEQ ID NO: 237 - DNA, 1166 bp, Homo sapiens
ggaatgtaagaattttataacttgttgctaatactttaaaaactttcagtaaaaattatccttctattttctcatttaataaaaaagtataacccaccttttagtctctttaaccataatactgttttctattttgtaactcatcatgtagtagagcatgcagagagctctggactgggagttaggaggcctggattttaattctgcttctgccatgacatatgtaatgtttgaaaatgaggttaggaagtagctgataaaagatagatggttagatgatttctaatattccctctgagaatcagttgattctatgattaatggctttattaatatcagaattactgaatttaattaatggtaaggagaatgttatttttgaatgggaaggtaccagctctttcaaatgagttttaatgtaatcagtttttatattgtatgtagctgggtcataggttttaaaagttttgccacttaattagcactttctttgcatctagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggtaagctcatcatgtaaatggaaattttgtcttcttgctcagtaccagcattttaataaatgtggttgactcttttaaagatagttgtttgttgttgttgttgttgttgttttgaggcagggtcttgctcttcacccaggctggagtgcagtggtgcaatctcagctcactgtagccttgaccttccaggctcaagcgatcctcccaccttagcttcccgagtagctgggactataggcatgtgtcaccatgcccggctaatttttgtattttttgtagagacggggtttcaccatattgcccaggctggtctcagactcctagactcaagcgatcttcctgcttcagcctcccaaagtgctgggattacaggtgtgagccactttgcccagcctcttctaaagataattttatttatctaatgttgttttcttttaggccttttcagatattaatggcaaagttcagaccattgttttgacatctggtacattatcacc

SEQ ID NO: 238 - DNA, 1141 bp, Homo sapiens
aacgttcacgacagaaaactgcagttcatgtgctaaacttttggtgcttaaatccagctgtggtaagctcatcatgtaaatggaaattttgtcttcttgctcagtaccagcattttaataaatgtggttgactcttttaaagatagttgtttgttgttgttgttgttgttgttttgaggcagggtcttgctcttcacccaggctggagtgcagtggtgcaatctcagctcactgtagccttgaccttccaggctcaagcgatcctcccaccttagcttcccgagtagctgggactataggcatgtgtcaccatgcccggctaatttttgtattttttgtagagacggggtttcaccatattgcccaggctggtctcagactcctagactcaagcgatcttcctgcttcagcctcccaaagtgctgggattacaggtgtgagccactttgcccagcctcttctaaagataattttatttatctaatgttgttttcttttaggccttttcagatattaatggcaaagttcagaccattgttttgacatctggtacattatcaccaatgaaatccttttcgtcagaacttggtgttacatttactatccagctggaggctaatcatatcattaaaaattcacaggttagttgttgtttttttttttggaaggccttcagtgtttctacttcaatataactatgtaaacaagttagaagatacctgaagtgccagcaagtaaatcttggtaggaaattcaacattccagttttacaataaaagaaaatctgtcagctacttaatgatgtgtcaacagaaggaaataatccagtcacttgggatgcaaaaggctgtatttcagcttcttcttctaagtaagttttagttttgtaatgaaaacaaaattttgatttctttaattctcattgtataattatgttttatttattgattgattgatttttgagacagagtctggctctgttgcccaggctggagtgcagtggtgtgatcttggctcactcgtgtttaagcaattctcctgcttcagcctctcaagttgctgagattacaggtgtgcgccgcacgcctggctaattttttatttttttggtagagatggggtttcagcatgttgtccattc

SEQ ID NO: 239 - DNA, 1162 bp, Homo sapiens
aataactgtaagatgtggtgggtgtgatttttttctatgactaaggatctttgagcaccaatgaatttttgaaagagtagttcctgtcatttttgagacttgcctatggcaaattatactggccttcatccccagtattttggaattatctgattctgctattggtatatattcatcatttcacttgttcatttattcacctaacaaaaatttgttacatgcttaaattttgcaaagctattaagtaaacagagacaggtacaacctgttttgctttcaaagaattttcactctaagagaatttagtgatctgcctaaagcaaaacatttataaattaaatctgtatacagttaattgaaggtaatagaaaaccccctgacaatttaaaaataaattgttaaacttgttgcttgatcttttatgtacatacttccaaataaatactaatttccatgcctttttcaggcataactctaataatgacatattcatattctaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaaggtaagggaatatttattgtttcttttgcctttaaataatcatttacattttaaacattggcatgctaattttaaaattaccacagtaagcttcctagggtagaggcaacaaggtaataactatagttttctaaacatcacatattattttacttattttttgattaagatactgcctgattgtcctacctctgttttacttaaaagtctgaaagagcaaggctggacgtggtggctcatgcttgtaatcccagcaggttgggaggctgagctgggaggatcacttgagcccaggagttcgagaccagcctggagaacatggtgaaactctgcctctacaaaatacaaaaattagctgggtgtggtggcacacacctatagtcccagctacctgcgaggctgaggtgggaggattgcttgagcccaggaggttgaggttacagtgagctatgattgcacccctgcactccagcgtgggcaacagaataagactctctctaa

SEQ ID NO: 240 - DNA, 1160 bp, Homo sapiens
cttagtaaaatgatcttaaatcatcttcatttgaagactatttaagaatattaagaaacttcaccttaggtttaaagagagaacttaaagtttgttaactttgacagaggttttttgttttttgcttttgcttttgaaattgccaagatagtagtagtagtagtagtagtggtggtggtggtagaaattgccaagataatagtagaagtagtagtagtaatagtagtagtagcagtagtagtggtagaaattgccaagataatagtagtagtagcagcagcagcagctaactgtgccagcaccattcagatctctctaaatctgttaataaatttaaccccataacagctctatgagatatattgttttcctcattttataaatgagaaaagacacagagagattaatatacttgccgtagtcacattggcttaaacaaatgaagttaagtttgtttagctagacacacaaaaaatcatttttttctttcccctctttagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaaggtaactggaaattatttcatggtcggtgaaaaaatattttttattacaaagtaagaaggtacaattataattttatatttttagatgaattacacttaagagaaaaattataatcctgagtgaaaagaaaataaattgggtaaagaaattcttttaattgtacttgttctcctatgaatattttcacttgagtatgctgattcaactttaagaaaaacgatgccatcatctcacagtcttcagtgcactacctgaaatagtttgtgcaaaaaggcagttaggatatatataaatatattccttactagccaaatgagacctatattctgatgcatttagtacacttggtgcttgtattctattacataaggtaaacttgaattttcaaaacataactgaaaactcaattccaagttagagcatatccatgaagagtttgatgtgaggccgggcgtggtggctcttgcctgtaatcctagcgctttgggaggctgaggcgg

SEQ ID NO: 241 - DNA, 1122 bp, Homo sapiens
aagaaagaggtaatataacatatcagtatctttttatggtgtatatattatggtgttctctgtgtctgttttcaatacttttaaatatattgattccatatgatatgtattatcaattacaattatttcaattattctgagaattttactttcaggtggtaaaggtaataatgcaacttcaatttttattaaataaacctgtttataatcacacagttcatatgcaagttgctattctgacatgtttttactgtataagttatctggaagatgcagagtttgtaaattggtttgctacccttttgcatataaatgtaattttgttccccttatttacttaaagacattgaacttttaaaactttatctcataatagtgttttattttgattattttaaatttgctactgtaattactataattataaatcaggtattttcaaaatgacaagaataagcaatttctgagaattttggatatgcttttttctgttgtttaagatggagctctcctggtagcagtttgtcgtggtaaagtgagtgagggtctggatttctcagatgacaatgcccgtgctgtcataacaataggaattccttttccaaatgtgaaagatctacaggtaggccatcaaaaccttaagttttattattacaggagtcattggttttgtataaagttaattgcagggatccctcattttattgcgctttgcttttatagtgcttttttacaaattgaaggtttatggtaaccctgcattgtgcaagtctttcagcaccatttttccaacagcatgtggtcacttgtttctgtttcacatttgggttaattctcacgatatttcaaaccttttcattattattatactgttagggtaatctgtgataagtgatctttgatgttactattgtaattgttttggggcatctcatactgtacccacataagagagcaaacgtaattcataagtgatgtatgtattctaactgctccactgactacccttcccccatttctctctccttgggactctccattccctgagacacaacaatactgaaattaggccagttaataaccctacaatggccccagagtgttcaagtgaaaggaagtgtt

SEQ ID NO: 242 - DNA, 1113 bp, Homo sapiens
ttctaaaagtatattaaatgaaaaatgtcacaagtcattacatagtatatgataatatttatatgaaattctataaagggcaaaacagaaagcagatcagtggttgccagggccagcagtggaagaaagaaatttactataaagggataagagggaacttttgggggtgatgaaaatgttctatattatgatggtggttacattactatatatgtcaaaactcacctacttgtacactgaaaattgtgtggatttaatgaatgtaagttcaataaaactgcttgagatcacacagctgattagttatatgcattaggtaatttaaggaatgtgaagctaaataaaactattttaaatgaaacgaaaaaaatcagtactgaaaaacaaaataaaatctctaccctaaaaatatgtatattcaaactgttagaagttaatatgatgtttaaaatgagctttaattatctactaattttttaaatatattttaaaattattaggttgaactaaaacgacaatacaatgaccaccattcaaaattgagaggtcttctacctggccgtcagtggtatgaaattcaagcatacagggccttaaaccaggcccttggtaggtaagtggagtgaaatttaatataatattatctgtgacagggctatatatataaatctagtcttgctactttactctttataataaacttggtaaaattttatttaactggaaccataggaactggtatgtattcaatgatagctgtcacaagtagaatttgaaaagagtaagaagaataagttattcccaaaacaaaactcacaatttgctaaagtttaaagaaattttgtgattgatctaacaatgaatagcacacaaagatgctcagtaaatattaaagaaagcttatcaaatcaaaaaagttttgtcttgtgaacatcaaagctcagataacaattttatagataaacagacctctctcctcacctcccccaaaatgtcagggaagaaaattgatataccagccagtgtgaggagatattctatttgaaagtgtactttcagtacggaatctgtgtatctgttaaaatatcatcaaatagaaacaaaatctatttt

SEQ ID NO: 243 - DNA, 1083 bp, Homo sapiens
gaatgcaaggatgattcagtgtttgaaaatgaaccagtgtaatctaccatattaacagtcaaaagaagaaaaactacatgttatgtcaattgaattttagaatatttttgacaaaattaaatgtttattcatgatttaaaactctcatcaaactagtaaaaaggacctttacaattatttataatacttaaggtaaaaaaaagaaaacagtctatgtggctaagaaagatcttagaatatattttctataattttcttgagtgcaaaataaaatacaacattttggatgcaagttatctgtatttggaaaaagtagggaatttttaatacatctagtttgttacattgtgttggatagcttctgtaacttttctgataataacaaattgtttaaaggaatctataaaattgatttttttccaattttctgtctgtcccactggaaaactggatttatttccgatgttataattatttgactttttccctattttttctagatgtattagacacagaaatgattggggagctcttattctagtggatgatcgctttaggaataacccaagtcgctatatatctggtaagatctcagctgggcttagagtaaaaactagtaacaatcttcatatttttattgtggtgaaaaacacataacatgagctctactatcttattaagtgcacagtacaatattgttaactataagcacagtatttcacagcagatatctagaacttttaaatcttacataactgaaacttaacaccaactgaacagcaatgccccatgtccctctcccccctgtccactgacaaccaccgctatactttctgcttctattagtttgactgttttggatacctcatataaattgaattatgcagtatttgtccttctgtaactggcttatttcagttagcataatgtcctcaaggttcatctatgttgcaggatttccttcttttcaatgactgcttaatattttattttatgtatacattataccatattttctttatccattcatctgtcagtagacatttaggttgtttccccctcatggatattgggaacaatgct

SEQ ID NO: 244 - DNA, 1330 bp, Homo sapiens
cagaataattttaatttaagatatatttggaattggtggaggaagggaacaaaaaaacttgagactagaatcttgaaattatttttgcaaaaggagtaaaatttagaatattagaatggaaagttgtattgtttacaacttctagtttccctacaaaaaaaaaaggcaatttttgtggggaattatgatgaaattaaatttgccatgttcaccagttattcttaaccagagaatatgttttcccatctctgccctacttctactgcctctttgctctctccatttgacaattactgtatataaagagaatgttactcatatgttactgatacatatgtagtaaaattgctgaattgcagaaaaaacatatggagaaccattctgtatattcaaaatacaaattaggttacttcactagaaaaagcaagtgtattaccttagcatgtaatattttaataactaagtaaccaaattttccctgggtttacctttttctttaggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaagtatgaaaagttcttcccatttacctttgatagagaagtctttcattatatttagtgaaatgatatttatttgggtatagattaattccttaaatatggtggtttgtaatataaggtgttatcataaaatagtgaaacagtatggtgtactgtaatgggaacaaacttttgtcaggagaccagagcatattttctggttttccactaactggctttgccacttactagctttgtgatcatgagcaagtcatttgtcctttttgagtcgtaataggaaaaaaaaaatgcctgcctagctatcccttcaggttgggttgtaaaggtcaaaattataaatatcacagcattgtaaagtaccatgtaagtggtagatgttattctaaaggctatataaaaatttggcctaatttttatgtagatacttctatatgaactacttttcctatatagatagttcttatgaacttatttttaggaggtgagagacatttattttaagt

SEQ ID NO: 245 - DNA, 5955 bp, Homo sapiens
ccgattaacttggtaatcaggaaacctagtttctagtcttggtcttcttactaaccagttttataactttgagcaaataacttagccttatgtcactttccttatttattaaataaaagaattagtctaggtaagtttttctcagtcactggttagtggattttcaaggcaaatgtttacagcctgttccctcctttcctcagctcccttcctcttcccttttaccccttctttcctcattcattcttgagctccctgctgtggaatttgatagtttaccagacagcattataacttgggctaggaaacattagagacctaagatttctttcagagttaatattctgttccaagatgaaaatccactagtattcgttgggggctctaagttatgtatcctatacagttatttaggtatttctaataaataattattttaacctagcaattatgttagctaggagcagaaagttaaatctcttaaattcttgtattcttagatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaagtggctcttactcatttacatttagggaacgatggtgacgtggtttggctatgtccccagccagatctcatcttgaattgtagttcccataatcccgacgtgttgtgggaaggacccagtgggaggtaattgaatcgtgggggcggttaccctcatgcggttctcgtgatactgagttcttatgagacctgatgattttataaggagcttttccctgcttcactctcattcttctctcctgctgccctgtgaaaagttgccttccgccatgattgtaagtttcttgaggcctcctcagtcatgcagaactgtgagtcaattaaacctctttcctttataaattacccagtcttgggtatgactttattagcagcatgagaacagactgacacagatggtatatgtgcataataacttggaaagctagatatttattttcgcaatgctacaattaaaacattttgaggacttttaaaattacctttagggccaggcgcggtggctcacgcctgtaatcccagcactttgggaggccgaggcgggcggatcacgaggtcaggagatcgagaccatcctggttaacacggtgaaaccccgtctctactaaaaatacaaaaaattagccaggcgtggtggcgggcgcctgtagtcccagctactcaggaggctgaggcaggagaatggcgtgaacccgggaggtggagcttgcagtgagccgagattgcgccactgcactccagcctgggcgacagagcgggactccgtctcaaaaaaaaaaaaaaaaagaaattacctttagaattggtaaactacatgagaaaattaagcatattattcatatcttagtgttattacccaacttcatctccaatactttcccctttccctagctagatatgtttttgtttgtttgttttagacagtcttgctctgtcgctcaggctggagtgcaaaggcacgatcttggctcactgcaacctctgcctcgcaggttaaagcgattctcatgtctcagcctcctgcgtagctgggattacaggtgtacaccactgcacccagctaatttttttttttttttttttttaagtatcgacagggtttcaccatgttggccaggctggtctcaaactcctgacctcaagtgatctgcccacctcggcctcccaaagtgttgggattacaggcgtgagccaccatgcctggcctagatattttttattctttccaaaatttaattctccctgaagttaaaaattttcattactgagaatgtacatagagatgtgtcacaaccctttagtaattccaaaaggtgtttcaaaaattttatacaatgataatcactgttgaaacaggtgtatattctcctcagatcatgactgaccaagatgatattccaagaagtaaactactggcctttatagagtaggatgtaggccattttcattactgataacatacttttaaaagaaatgtttacagatttaaataagttaaaacatctaaatgcttttaaaagagcacctggcacattgcaagttattcattattaattagtagatgaatcatatatctggagtgcacccttgctctatatgaaagcttccctaactatagatatataggtgatagactgacaataaagatttgaggaaagaaaaattatttggctggcttattttttaagcttttgagatgtataaggtagagattgtttatcaaataatttatgtgacacattcaatgcatatgaaataattatctaatactgaatttattcaaggactgaaagtatatagagcacacaggctgcaaaccaggaaaactaccagttagagacagggctttattcttggaataaaggtacaatgtaaagagtagatgtttcatgacttgattaaattatttaaaactgtctagaattgtgttataaaactattactatgtttctatgcacttagttattacatgggtttaaatttggcactgtttctaagtttctataaggctttgttgttaagatctttctattcaaaacattaattttaacaaaaagcttttccccgttatttttctgcaactggacttttttgtattactttcctatattaaaacgcatttaaaatatttaattctttagggctgcttacaaaatttcatgaaatcaaagcacctgttgtcaaatcacttgaaaggctggttatcatggtcatctctaagtgatggcattcttttgtatttgattaccacacaattattctcgcatatgctcttttaaacgctgatttctcaatgagttacacaagaatttaacctttatgaattcttggtggtttattatctatttccataggtaaatgcagttaatcttttgtaaatagatagtattgatgataatcaaaaaaaattttaagaccagatcaagcaatgaatgtaagaaagctaaaaccttaacgtaaaataactgcagagctatgaaaaatacaataaagaacatcaggaaatagaaatttggaaaagtgaccaaggcttatgatcctctagccttaaacaattttcatgtctcaaaaaaaaaaaaaa

SEQ ID NO: 246 - DNA, 1500 bp, Homo sapiens
gcacccttgctctatatgaaagcttccctaactatagatatataggtgatagactgacaataaagatttgaggaaagaaaaattatttggctggcttattttttaagcttttgagatgtataaggtagagattgtttatcaaataatttatgtgacacattcaatgcatatgaaataattatctaatactgaatttattcaaggactgaaagtatatagagcacacaggctgcaaaccaggaaaactaccagttagagacagggctttattcttggaataaaggtacaatgtaaagagtagatgtttcatgacttgattaaattatttaaaactgtctagaattgtgttataaaactattactatgtttctatgcacttagttattacatgggtttaaatttggcactgtttctaagtttctataaggctttgttgttaagatctttctattcaaaacattaattttaacaaaaagcttttccccgttatttttctgcaactggacttttttgtattactttcctatattaaaacgcatttaaaatatttaattctttagggctgcttacaaaatttcatgaaatcaaagcacctgttgtcaaatcacttgaaaggctggttatcatggtcatctctaagtgatggcattcttttgtatttgattaccacacaattattctcgcatatgctcttttaaacgctgatttctcaatgagttacacaagaatttaacctttatgaattcttggtggtttattatctatttccataggtaaatgcagttaatcttttgtaaatagatagtattgatgataatcaaaaaaaattttaagaccagatcaagcaatgaatgtaagaaagctaaaaccttaacgtaaaataactgcagagctatgaaaaatacaataaagaacatcaggaaatagaaatttggaaaagtgaccaaggcttatgatcctctagccttaaacaattttcatgtctcaaaaaaaaaaaaaaagaattttgtttcttaagtttcatttgatagaaccattagctgcctggcttcctgtactccacaatggagccttgttataatatacatgggatctgagccagcagatcaccttattggtaagactaccttataatgaggtgctttcagtaactaaaccctcttggaccaggtccaaaacaacccatcttacaccaaattccactctgtaataaacaagcgtcaatgtattggaaagaaaacaaaagctatatgaaatttactgttcccagaaattaacctttgaaaacccaatggtaaatactgattaaaaggaatgtgtaacaaggcataattagatagatattttagtacattttataataactttgtattttcttggctcagtcttcctttattcgggaatttatattattttgattatcttaacgctttccccaaaatttcatcatttcacatgaaaatattttacattaatatttatagaattcaatattaaagt

SEQ ID NO: 247 - DNA, 4815 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 248 - DNA, 1500 bp, Homo sapiens
attaggccgctcgaggcagagtgcagtggctcacgcctgtaatccaacacttcaggaggctgaagagggtggatcacctgaggtcaggagttccagaccagcctggccaacatggtgaaaccccgtctgtactaaaaatacaaaattagccggtgtggtggcacacgcctgtagtcccagctactcaataggctgagacaggagagtctcttgaacccggcaggcggaggttgcagtgagccgagatcgtgccactgcactccagcctgggcaagacagagcgagactccgtctcaaaaaatacaaacaaaacaaacaaacaaaaaattaggctgctagctcagtggctcatggctcacacctgaaatcctagcactttgggaggccaaggcaggaggatcgcttcagcccaggagttcgagaccaggctgggcaatacagggagacacagcgcccccactgcccctgtccgccccgacttgtctctctacaaaaaggcaaaagaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggt

SEQ ID NO: 249 - DNA, 1172 bp, Homo sapiens
aaagaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctc

SEQ ID NO: 250 - DNA, 1115 bp, Homo sapiens
ggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtactggagaataaagacatctccaataaaatgagaaaggagactgaaagggaacggtgggctaggtcttgagggggtgactcggcggccccctcccgggagttcctgggggctcggcggccgtaggtttcggggtgggggagggtgacgtcgctgcccgcccgtcccggggctgcgggctggggtcctcccccaatcccgacgccgggagcgagggaggggcggcgctgttggtttcggtgagcaggagggaaccctccgagtcacccggttccatctacctttcccccaccccaggtctcctcttggctctgccaggagccggagccctgccaccctggctttgacgccgagagctacacgttcacggtgccccggcgccacctggagagaggccgcgtcctgggcagaggtgagggcgcgctgccggtgtccctgggcggagtagggaggggttggaaaggggccgagaaattgcactcccacacccctgggttgcaatgggcaagctccctccttggctcaaacgacaccccttggaatttacgcagatttggggatccaaacgtttacgactgaacactgtggtggagggggtaaccctgcctggttgttgactatgttataaagaagaggaggttgagggcacttactagaagccttcgtatttctcttattgccctcagcactgtagagacagtctctcatttcagactgcaaaaacctggtgggtgggaaggcctggcaggagtattcccgttttacagttgagcaaaccgaggctaagagagtgacgtccacttgctcagggtcagcagagcagatatctgaactgggatctgactcccaggccccattaagcaccatctctgggatgactgaagagcagccctctcttggttactgggctgt

SEQ ID NO: 251 - DNA, 1224 bp, Homo sapiens
ggcgcaatctcagctcactgcaacctccaccttacaggttcaagagattctcctgcctcagcctcccaagtggctgcaattacaggcgcctgccactaaacctggctaatttttttttgtatttttagtagagacagggtttcatcatgttggccaggctggtctcaagctcctgacctcaagtgatctgcccaccttggcctcccaaaatgctggggttacaggcatgagacactgtgcccagtcgagaagttactttctagacaagataatattttcaattgacaagaagatgagaaagaaatcagagcacaaggaagtcatcctgtagttgtgaagaacattatggtgatagctttgttgttctgtcaccagattatggtttgttttggttgtgtttggttttgtgggagtcttcccacaagttcgctctttggagaaggaatgctcttgtctttaatctgtccaatttcctaatctctgtgatttctgccctgcagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggtatgttggcatttttctgagaagttcgctgttgttttagtgcgctgtctaatccaggtttctcagccttggtaccgttgacattttgggctggatgattttgtgttgtaggggttgtcctgtgcactgtgtaggatgtttagcaagcatccctggccttaactggttagacaccagtagcacttccaccagttatgacaacccaaagtatctccacatgttgcccatggcccctggggggacaaatcagcccaagttgagggctcttggcctaactgaataattcttgctggagtttttggggtgtggggatcgggtagtgtagaagagtggtaaaggcctgaacaccgtctgggactgaatctcagccgtgctatttactacttgggtaatgttggaggaattacgtcacctgtctatgcttgagcttccttatctgtaaaatggagataacagtgaggatggaattaattaatacatgtgaaatgctaaaaatacgc

SEQ ID NO: 252 - DNA, 1144 bp, Homo sapiens
tagtcagccatggtggtgcacacctgtagtcccagctactcaggaggctgagatgggagggatggcttgagcctgggaggcagaggttccagtgagacaagatcttgccgctgtaccccagcctcagtgatagagccagatcttgtctcaaaaaaataaaaatgagattatgtaggcttgaaacagcttgtaaattataatatcaaaccctgaaaccaatacttgtgtatgcatgatgattatttgagctctggacactaagaaggataaaaagagaatgcagtctttacgatatagcaaagggtctcattggtttttgttttgattggtcattttggtggatatatataatttgtcattgataagagaatgtgtcattaaattcaaactgtacactgcccacagaaggctggggacgctgtctggctaggttggactgttagacctgaagtatccgtcttgaattgtcttatcttgttcctcatcttctttccttttaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcaggtagagaaagaagttctctgtttctctgggagggatttggcagagaagtaccaaggagagaaagggaaaagacccagtgttgggatccttctttactaattctttttctttcattttgtcttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtgggacagtttggggttgttaatttttctccttgtcaggaagaaaggaaggagaatccgcat

SEQ ID NO: 253 - DNA, 1156 bp, Homo sapiens
aaaagagaatgcagtctttacgatatagcaaagggtctcattggtttttgttttgattggtcattttggtggatatatataatttgtcattgataagagaatgtgtcattaaattcaaactgtacactgcccacagaaggctggggacgctgtctggctaggttggactgttagacctgaagtatccgtcttgaattgtcttatcttgttcctcatcttctttccttttaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcaggtagagaaagaagttctctgtttctctgggagggatttggcagagaagtaccaaggagagaaagggaaaagacccagtgttgggatccttctttactaattctttttctttcattttgtcttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtgggacagtttggggttgttaatttttctccttgtcaggaagaaaggaaggagaatccgcatgcatcctcatacaaccaggacaaatttagacccaagatgtcaacctgttcttggggctggaagtccctgacctaaaggaacaggacagtgatgatataagggagcaaaacccatttcttgggcttggcagcagcaagagcttaggaaaaccaagaggtcttttttttttttttttgagatagggtttcactctgtcacccaggctggaaccacaacctccacttcccgggttcaagtgattctcctgcttcaacctcccgagtagctggattataggcagc

SEQ ID NO: 254 - DNA, 1145 bp, Homo sapiens
tgtattttttgtagaaacaagatcttgctatgttgcccaggctggtcttgaaatcttgagctcaagcaatctgcccacctcggcctcccaaagtgctgagattacatgaaccactatgcctggccaggaagtcatatattgatgccaaattcagaaatatctgggggaaatgctagactaaaaggaccagagcaagtttcacccggcatggaataagagtttttcaggcccgcatcttcatctctaggcctgatgccctggtcctcgtgtgggaaatgggaggtctgagccgtggggggtgttctccagcccatggctcttaccttgttataatctcactgaagcagcagcagcacatgtgtgagaaaagtcacccactgggggtctcagagcctaggaaggtgtggcagccaggggggcgcactctgctctggctgggccccttctcccatgttttcttcctcatcagagctcaagtcaccctcacttggttctttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggtatatccactaatgagaatctgaatactcagaaagactcttaggttctttggaccccaaagtgttgtccaagcccaaaggttgtgtaactaaagctgatccttcctacggacagaacttcttggcaagccattgttgtgttatatgcatgtgtgtaacagtctacctgtggaaacatataaaatagggagagtttaagaacaatcttcccttttttattattaattttttttttttttaggctgggcatggtggctcatgcctgtaatcccagcactttgggaggccaaggtggatgggtcacctgtgctcaggagttcaagaccagcctgaccaacatggtgaaacctcgtctctattaaaaatacaaaaaaattagccggtcgtggtggcgggggcctgtaatcccagctacttgggaggctgaggcaggagaattgcttgaacccgggaggcgggggttgcagtaagctgagatcacgccactgcactccagcctg

SEQ ID NO: 255 - DNA, 1176 bp, Homo sapiens
ggtcaggagtttgagaccagcctgaccaacatggagaaaccctgtctctactaaaaatagaaaattagctgggcgtggcgacgcatgcctataattccagatacttgggaggctgaagcaggagaattgcttgaacccgggagacagagattgtggtgagccgaatcacgccattgcattccagcctgggcaacaggagcaaaactccgtctcaaaaaaaaaaaaaaaaaaaaagataaccacaccctgacttttgtggtaatcattccctttcttttctttattaccatttgtgtatttatacctggataataagttgatagtttgagctttctttctcccctagcactttggtaagaattctaggaattagggaactctgacacggtaccacccccatgtcccctcctttatccctcagggcagaattggattaagcagtattgacccagtcccaaagtgcagcttgtctaaaccttcatctccttgaactcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgcccagaggttccgtgcctagaagacaggcaggctggcatgaagcacatggttaaatattctggttccatgtgttgggctgggctaggccaaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtctttgaaaac

SEQ ID NO: 256 - DNA, 1129 bp, Homo sapiens
gtcccaaagtgcagcttgtctaaaccttcatctccttgaactcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgcccagaggttccgtgcctagaagacaggcaggctggcatgaagcacatggttaaatattctggttccatgtgttgggctgggctaggccaaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattaggcactgtgttagacactggagagaccatcacacacaaagattccattctcatggtgtttctggtatagccaggaagacatcttatgagaattattgtatgccaaggatattacatgcattcaaggagaaggtattgagaaccaagtagggtaagtttaaatcatcctgtataatggcc

SEQ ID NO: 257 - DNA, 1183 bp, Homo sapiens
ggtggatcccttgaggatggagtttgagaccagcctggccaacgtggcgaaactccatctccactaaaaatacaaaaattagctgggcgtggtggtgcatgcttgtaatcccagctactcgggcatctgaggcatgagagttgcttgaacccaggaggcggaggctgcagtgagccgagattgtaccattgcaccccagtgcgcccattgcctggcctctccttgtcacatcttctccttgaagcttgctttcagttagccaggtgtggtggtgcatgcctgtggtcccagctactctggaggctgaggtgggaggattgcttgagcccaggaggttgaggctacagtgagccatgatcgctcaaatacactccagcctggtgacagtgagatcttatctcaaaagaacaacaaaaaaagaggaatcctttagccccctgagactcagctctgctagcagtcttggtactttgtaaatgacacatctctttgctctgcagtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctggtatcttcttagaagtagattcgctttggcagggggacagggtgactttcccagattgtagtggaccatgtgggatttgcagtggctcttcctgctcatgtaagaaatcaagaaactgtgctgtgtgtggtggctcacgcctgtaatcccagcacttagggacgctgaggcaggcagatcacgaggtcaggagtttgagtctctgctaaaaatacaaaaattagccaggcatggtggcacgtgcctgtaatctcagctactagggaggctgaggcaggagaattgcttgaacctgggaggtggaggttgcagtgagccaagatcgtgccattgcactccagctctgggtgacagagcaagactcagtctccaggggtgggcggggaaaaggaggccgggcgtggtggctcacgcctgtaatcatagcactttg

SEQ ID NO: 258 - DNA, 1245 bp, Homo sapiens
caggagttcgagaccagcctggccaacatggtgaaacgtcgtctctactaaaaatacaaaaaattagccaggtgtggtggcgggctcctgtaatcccagctactagggaggctgaggcaggagaattgcttgaacccaggaggtggaggttgcagtgagccattgcattccagcctgggtgacaagagcaaaaattctgtctcagaaaaaaataaaataaggaaagaaacttgaaaactaagaatttgagtgaattgcttgttgaagtgactggatccctagaatagccccagctttgccttcctcttgagtaggtgagcagatttgagaagccatggtaagtaattgtggtttctgccattgaaagtcatggcagaaaccacagttacttttgcaccaacctaatatattaccaaaagcaacagttaaggatttaattttatttttactaacacaaaatgtttcgttttgtttttaacttcattgtttctgctctctagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgtaagtgtgaggatttttcaactgacttgcagcaactggttattttatatcattttatatgtaaatcaataatatgtacttcatggcattttgtcatttgtctgtacaagaccattctcttaatttattttttattccctttatctgtgctcctttcacctgttcccttcccttcacagacagccgttcttggtctgatgtgctgcctctctttgagctcttgtagtatggtagaaatgcaattttactttgcatacatactattgtgtttttttgagtttggagtctcactttgtcgcccaggctagcgtgcagtggcgtgatctctgcctactgcagcctctgtctcttgggttcaagcaattttcatgcctcagccttccatgtagccaggattacaggtgcctgccaccacgcccggctaatttttgtatttttagtagagacaaggcttcaccacattggccaggctggtctcgaacttctgacctcaagtgatc

SEQ ID NO: 259 - DNA, 1146 bp, Homo sapiens
gtggagcttgcagcgagccgacatcgcgccactgcactccagcttgggctacagagcaagactccgtctcaaaaaaaaaaaaaaaaaaaaagaaagaaagggtttcacttttgttgcccaggctggagtgcagtggtgcaatctcggctcactgcaacctccatctcccaggttcaaacgattctcctgcctcaccctccccagtagctgggattacaggcgtgtgccaccacacccagctaatttttgtatttttagtagagacagggtttcaccatgttgaccaggctggtctcaaacccctgacctcaggtgatctgcccacctcagcctcccaaagtgttgggattacaggcatgagccaccgcgaccggcctattgttggttttcaaaataaaaacgttggaagtaaccatataactgaagaagcgcttaagccgttttcagctacatgttgtttgctggtcctattctaaaagccagagcttgtccccgttcagatatcggatttggagagacactgccaactggctggagattaatccggacactggtgccatttccactcgggctgagctggacagggaggattttgagcacgtgaagaacagcacgtacacagccctaatcatagctacagacaatggtaagggggcctcatctgagcctttgctgcctcgacctcctagctagttcagttccttgcccctcccttcttttggagggaagagttcattctttttcttttatcctttttgtttgctggattgatttgtataaatgtatggagtacaagggtaattttgttacatgcatagatgtgtagtggtaaagtcagggcttttagggtatccgtcacccaaataacatgcattgtacccattaagtaattgttcatcatctaccccctcccaccccttggacccttcccagctgccattgtctatcattccacaatctacatccatgtgtacacattatcgaactccgacttctaagtgagaacatgcagtatttctccttatatgtctgattcgtttcacttgagacaatggcctccagtttcatccatgttgctgcaaaagatttctcttttattcttaaacaaaggcattcttattatcaaaaattcaagtgggctgggca

SEQ ID NO: 260 - DNA, 1225 bp, Homo sapiens
ccaatctattttgaaaaccaatttgcagagacttcaaaagacccaactcatcccctttgattttaagcttctagtcaggcttaaaattaaaataaataaaaagactcaatgctttgttaatgacctcaaatggcaggaaagtgcagaaaaaggagaactagggaaacaacaggcaggcaataggacttcttggagtagttaaaattcagtgaatgaataacgatatgtgaagaaggaggagtgtgttcttggtgtgaggaataacttgaataattgttatcaaggtgggaataagttgtctgtgtaaaacggccagagacctgcccacctgggagtggaggtcctttgggattggtgggacaggaggttctgcgggtggagtggggcctggtgagggaccactgaagagccaggacaagatctagacttggtctggtggaaggcaatggggattcattactgttgccaagctgccacattttctgtgtattttctcttaggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaagtgggtacctgagttttattttggcaactttgctccaactgccatgcttcccttcccccagatccccacctttcaatttcccttctcaacttctagatgtcaccccttccattgatacttgcttccttgtcccttctgtctttgaggccttgctccaaaggtctttttcctttcctggtatctaactttgtagcatgctacccagtaatctaaaacccaagcagggctccctctcccagcctctagccaccctccactcccctctccacttgcaaccaggaccatcttctctgctacctcctgctcctgggaccaaacaacaccatttttgtggttagctccttcttgccaaccaatcgtgagctcccagattcatcagaactattctaccgaggtggaggcagctgtcaactgcctggtcaatttgcatatatgggcttcctacacctacttctctctgggcttctatttccaccatgacgatgtggatctggaaggtg

SEQ ID NO: 261 - DNA, 1228 bp, Homo sapiens
aacctgaactggacccttttggatcttcatgccttgggttccacctgcacagacccccatatctgtgacttcctggagagccacttcctagatgaaaaagtaaaactcatcaagaagataggtgaccacctgaccaaccttcacaggccagccggcctccaggccgggctgggcaaaaaggttcaccctcaggcacacgggagcctaccgaacccagcgacatctgaagagccccgctctgcctaagcctctccctccagccactaggcagcttttttaaaccaactctagagccctctcccaagccttagaccaaatggaaataaagctttttacagcaaaaaaaaaaaaaaaaaagtacatacctaaataaaacccaagcagctctgctctcttcactcggcttgcgggtgtctttagttcactagcaattttattctggaatgagctttttattttcctcccctggtctcatcatttctttttattgctttctccagcccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaagtaagtccagctggcaagtgactcagcctttgacttaaaaaaatggaggaggtttatttcctggaaatgatttttgttcttatattaataaggatataggttagctgatgtgggaaagagactcccaagttatgccagcctccataaaatagaagtttgtctcttactgaacatttcagaggtaaatggtctaagatgggaaggccatgaagtcaacaggggacccaggtttcttctaccttgtctcttttcattcttcaagacagtgcatcccaagcttgagagcatacaaatcatctgggcctctttttgaactgggaaatctgatccaggaggtctggcatagggccacagattctgcatttcttttttttttttttttttttttgagatggagtttcgctcttgttgccgaggctggagtgcaatggtgtgatctcagctcactgcaccctctgcttaacaggttcaagcgattctcccgcctcagcctcctgagt

SEQ ID NO: 262 - DNA, 1131 bp, Homo sapiens
ccttcaatggctccaactcagaatcaaagccaaagtcctcacagtggcccatatgtccctcccgccctgcttgcccctctgagctcttctccatgtctcttcccctcatgcaccctgctacagccatgctggcctcctcaccttccctccatcacaccaaacatgctcctcctgcctcaggacctctgtccttactgtttcctctgcctggaacactttcccccagatttgggaaaatgacagtgattgagtttaaaacccatctgaaagttaaggaccatgcttgagttcacatatcactgtctactatgttgtactgtacataccgacttcagggatgtgagtgtcacgtggattgacatcttcaagtgtattgaaggcagctagtggctgtctaactgccccctgtctggtatgaggggtgctctgtgatagctgctgcttctggccttctttatctttggctctcaacacttgctctgtctcccccaccatcccagttctgattctgctgctcttgctgtttcttcggaggagagcggtggtcaaagagcccttactgcccccagaggatgacacccgggacaacgtttattactatgatgaagaaggaggcggagaagaggaccaggtgggttttgaaaaccttggtagctcagtggtgatctctttattcggaagaagcaatgattagtaagaggtaggcatttgaaacagctctgaatcactttggatattatctttttaaggccttacccaagaaagtagacattgtcattgaccatcatcatcatcacatcatcaccaacacagctaacatttattgatcgcatactgttctgcacctcagtgagcgagctgaggcacagagaagctcagtaacttggctaaggtcacacagctaggaagcgacagggctaaatggtctgtctcagagcctgccttcctcattgccattctctggacgtgaacttcagccagattctctttgacatagaacaactggtctgctttgtttcttttgagtttttagctagaccaaactccttttctgtcatggttataccttcagtccctctgtatttcctgattttggagatgatcttaacatcttaccctggagttgtccag

SEQ ID NO: 263 - DNA, 1144 bp, Homo sapiens
gatttaggcagagtttagctgaatggctctaacctgtgaattgtgtccaggtctgttccatgcaagtctcatctttgtaccagaagctggtgcctttcagacctttgcctgtgtcatatgttactgtcccattggctaagcaagtcacacaacaaagccccagatcgatggatgtatacttttctcacaagctggggttgggagggagtgaatatttgccaaacagtgatctaatcatcatgtcctatgaaaattagtaaggcacacagcctatatctggatccacacatgctactcacaatcctttgggccatgtttttttccagtgctatttgggagacttttagcttgaaaactgtcattttgcattaaactggtaaagatcatacagttggcagtgaaggcatcatccaaccataatctataaactgaacatagccctgtgtgtatgactatttctttcctactcttcattgtacttcaaccttttttctccaaaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaagtaagtaatccacgtggaaagccaaagcatggctcatctctaagctcaggaggagttgtgtcaaaaatgagaaaaagagtctttagattctttcctttactatgttttcagcttgcctgagccctggagccctgttttcctttttctttttttttctttttctttttttttttttttgagacgaagtttcactcttgttgcccaggctggagtgcaatggcgcaatctttgctcaccacaacctctgcccgggttcaagcgattctcctgcctcagcctcccaagtagctgggattacaggcatgcaccaccacactcagctaattttgtatttttaatagaggcagggtttctccatgttggtcaggctggtctctaactcctgactcaggtgatccacctgccttggcctcccaaagtgctgggattacaggtgtgagccaccgcacctggcagcctgtttttcttaatctgtgtctcatctgaattttggatctaat

SEQ ID NO: 264 - DNA, 3252 bp, Homo sapiens
agcctgtgtgacaagagtgaaaccctgtctctaaaaaaaaagaaaaagaaaaaaaatacaagtccttccttagttcccacacccccactccccagatttaactgttaagcatttggcatttatccttccaggcctttctgggtggaaatgcagcctgcatgcaccagtatgcaaagcttccagctctgcccatcccagctggtggtgtggcagccccactctgatctatggggactccatcctgactggttggtgcttgcatctctcctgcctacatataactcaccatttcactttctctttccatcaacaacatatcctgtgcttctgcatccttccatgacagtgtgtataaatgtacgttgttggtgttcactgctccgtggtgtgccacaagtctgggtgcattgtcgtaccttacatattgctagacttcttgccccagatgacaggtgtgcccttcctttcactaaaagatgcttttgtcccttcttctttagaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattgtcaaatttgttttatttgattccaccacatttccagtcaagagaaaagatgcatggagatggcctcagtcaaaacgtggagaaagaggccgggcgcggtggctcatgcctgtaatctcagcacttcgggaggccgaggcaggtagatcacttgagctcaggagtttgagaccagcctgggcaacgtagtgaaaccctgtctccacaaaaacacaaaaattagctgggcgtggtggcgcgcgcctgtagtcccagctactcgagaggctgagacatgagaatcacttgaactcaggaggcagaggttgcagtgagccgaggttgcgccactgcacttcagcctaggtgacagaggagactccatctcaaaaaaataaaaaaatttttaaaaaacttcatgctgaagtgacttctccagaagtttctatcattctactggatgaacatgggagaaactacattcacatggtaactttatttgaacagtatccatccatgt

SEQ ID NO: 265 - DNA, 1500 bp, Homo sapiens
gatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattgtcaaatttgttttatttgattccaccacatttccagtcaagagaaaagatgcatggagatggcctcagtcaaaacgtggagaaagaggccgggcgcggtggctcatgcctgtaatctcagcacttcgggaggccgaggcaggtagatcacttgagctcaggagtttgagaccagcctgggcaacgtagtgaaaccctgtctccacaaaaacacaaaaattagctgggcgtggtggcgcgcgcctgtagtcccagctactcgagaggctgagacatgagaatcacttgaactcaggaggcagaggttgcagtgagccgaggttgcgccactgcacttcagcctaggtgacagaggagactccatctcaaaaaaataaaaaaatttttaaaaaacttcatgctgaagtgacttctccagaagtttctatcattctactggatgaacatgggagaaactacattcacatggtaactttatttgaacagtatccatccatgtggcatgtgatgaaaccaataaaattcccatgtccacgggagactgtgtgggccaagctgaaggacgggacagagcaaagtttcaaacgatgttctcggggtcagcaagtgagtacaggccagtggttctctgctggggaagaatgtagccccctcctccatgtgacattttgcaatttctggagtacctggggaggtggtcttgtcaccacatcaaggccaggggtgctgctaaacatccctgcacgggacagttcctcacaacaaagaattatccagcacaaaatgtcagccactgttaagaaaccctggtgtaagcctaaaacttttctctgttgaaggggtatgacttttttctttgggtaattttttattgtaaaatacaacataaaatttatgattttagcccttttgttaagttttcagacagggtctcactctgtcacccgggctggagtgcagtggcacaatcacggctcgctgcagcctcaatctcccagt

SEQ ID NO: 266 - DNA, 2003 bp, Homo sapiens
cacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtcttttttttttttttaatgtttcttcctctgtttggctttgccattgtgcgatttggaaaaaccacttggaagaagggactttcctgcaaaaccttaaagactggttaaattacagggcctaggaagtcagtggagccccttgactgacaaagcttagaaaggaactgaaattgcttctttgaatatggattttaggcggggcgtggtggctcacgcctataatcccagcacgttgggaggccaacgcgggtggatcacctgaggtcaggagttcgagaccagcctgactaacatggtgaaaccctgtctctactaaaaatacaaaattagtcaggcgtggtggtgcacacctgtaatcccagctacttgggagactgaggcaggaggatcgcttgaacccgggaggcagaggttgcggtgagccgagatcatgccattgcactccagcctgggcaacagagcaagactctgtgtcaaaaaaaaaaaaagaatatagatttttaaatggca

SEQ ID NO: 267 - DNA, 1500 bp, Homo sapiens
aaatgagtagtcacaaggtttgcagaagggggcatgtcattttcattcattgtggtggtctggagggtgcagggggtgtggtggtaactttcttgcacatgtgcaatcctgtatccgtcttatatatgatgtgataaataatatcatatacatacatatatacatagaagcatatatgcacacatacaaatatcacataatcatagaaccttcctactggaaaaaaaaaaaaaacttaaaaggtcaagtattcctgtctcctgctcatcaataacttctctgccagatggcctcaggtctttgcattaacactcccagggaggtttggaagttggaaaagtgagaggattaccttgtcactgagcctgttggattactgtattaatctgccttccgtcatcctttaatcgtagttttgccctcaaatgggcattgtttactccctattgtagaagaccccattgttggctacatctttatagatagtcgtaccactactttaaagggccagtgacagacaccaaaaacaaaataaaaacccacatacacactggaagcaagcactcagtaaaatgttgtagaattaatgaatgaaacaatgacacaaatgagagtatgttttctcatggtggagcgaaaaggtgacagcatcacctctggtaccccaactcccaccccctccccaatgcagacaggctgaaagaccggtagtgagactggagttcagccttcagaccggtagtgagacaatccttcagccgggagttgggctctgggtggcctaggttgccatggcaccgcctcgggctccaccctctcttgtccccctcaccgctccccccctgcagcgggggttgtggcagccagtcacgtgcccgccgcgtagccacacctctgctcctcagagcaatgtcaagcggtcacgtgtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaag

SEQ ID NO: 268 - DNA, 1273 bp, Homo sapiens
taaagggccagtgacagacaccaaaaacaaaataaaaacccacatacacactggaagcaagcactcagtaaaatgttgtagaattaatgaatgaaacaatgacacaaatgagagtatgttttctcatggtggagcgaaaaggtgacagcatcacctctggtaccccaactcccaccccctccccaatgcagacaggctgaaagaccggtagtgagactggagttcagccttcagaccggtagtgagacaatccttcagccgggagttgggctctgggtggcctaggttgccatggcaccgcctcgggctccaccctctcttgtccccctcaccgctccccccctgcagcgggggttgtggcagccagtcacgtgcccgccgcgtagccacacctctgctcctcagagcaatgtcaagcggtcacgtgtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcg

SEQ ID NO: 269 - DNA, 1237 bp, Homo sapiens
taggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtga

SEQ ID NO: 270 - DNA, 1136 bp, Homo sapiens
tggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacc

SEQ ID NO: 271 - DNA, 1168 bp, Homo sapiens
gaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttg

SEQ ID NO: 272 - DNA, 1110 bp, Homo sapiens
acctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaattaggaacttcatatccctttattctctttattttttatttatttatttatttatttatttatttatttatttattta

SEQ ID NO: 273 - DNA, 1051 bp, Homo sapiens
ttttttttttagatggagtcttgctctgtcgccaggctggagtgcagtagtgcgatctctgctcactgcaacctccacctcccagattcaagcaattctcttgactcagcctcccaagtagctgggaccacaggtgcacgccaccatgctcagctaatttttgtacttttagtaatgacagggtttcaccatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgagtaagtgaccaacatgggagaaaaagattttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaagg

SEQ ID NO: 274 - DNA, 1136 bp, Homo sapiens
accatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgagtaagtgaccaacatgggagaaaaagattttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatctcagctacttgggaggctgagataggagaatcacttcaactcaggaggcggaggttgcagtgagctgagatcataccattgcactccagcctgggtgatagagcgagactccgtctcaaaaaaaaaaaaaaagaaaaaagaagaaagctcatcccaggt

SEQ ID NO: 275 - DNA, 1891 bp, Homo sapiens
gcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatctcagctacttgggaggctgagataggagaatcacttcaactcaggaggcggaggttgcagtgagctgagatcataccattgcactccagcctgggtgatagagcgagactccgtctcaaaaaaaaaaaaaaagaaaaaagaagaaagctcatcccaggtattgttgtgggtgggcagaagtctgttttcttcatggttttctgacctttgcctctcccctcaggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtcttttttttttttttaatgtttcttcctctgtttggctttgccattgtgcgatttggaaaaaccacttggaagaagggactttcctgcaaaaccttaaagactggttaaattacagggcctaggaagtcagtggagccccttgactgacaaagcttagaaaggaactgaaattgcttctttgaatatggattttaggcggggcgtggtggctcacgcctataatcccagcacgttgggaggccaacgcgggtggatcacctgaggtcaggagttcgagaccagcctgactaacatggtgaaaccctgtctctactaaaaatacaaaattagtcaggcgtggtggtgcacacctgtaatcccagctacttgggagactgaggcaggaggatcgcttgaacccgggaggcagaggttgcggtgagccgagatcatgccattgcactccagcctgggcaacagagcaagactctgtgtcaaaaaaaaaaaaagaatatagatttttaaatggcttttacttttatattcgctaaactttctcaaactggatcctgcttattacaggaaagagttcttggttgttttctccttggccctatccctgatttacccttagagccacaccagggtatgttgaggtgatccagtatatggacagaggaagggaaacagctaagaatgactccagcccccatcctatgcactcacagaagcttcccatatcctcttggagagagaggaagaaagtttttccttttattccttatagtctggctcccactaaaatatgtcaaggcataaagtcttgctattccatcaattttagaggatgtgacaaggggcctttcctttttctcaaaccaaaacggttacagaccctagatattccctaagggaggaagagaaagcttagagagagcagaagaaaagtcagaaggatccaaagtctcatagaaaggcactggggttggctctaggatccttctgattccgaaatctcattgctagccaa

SEQ ID NO: 276 - DNA, 1500 bp, Homo sapiens
tttttaatgtttcttcctctgtttggctttgccattgtgcgatttggaaaaaccacttggaagaagggactttcctgcaaaaccttaaagactggttaaattacagggcctaggaagtcagtggagccccttgactgacaaagcttagaaaggaactgaaattgcttctttgaatatggattttaggcggggcgtggtggctcacgcctataatcccagcacgttgggaggccaacgcgggtggatcacctgaggtcaggagttcgagaccagcctgactaacatggtgaaaccctgtctctactaaaaatacaaaattagtcaggcgtggtggtgcacacctgtaatcccagctacttgggagactgaggcaggaggatcgcttgaacccgggaggcagaggttgcggtgagccgagatcatgccattgcactccagcctgggcaacagagcaagactctgtgtcaaaaaaaaaaaaagaatatagatttttaaatggcttttacttttatattcgctaaactttctcaaactggatcctgcttattacaggaaagagttcttggttgttttctccttggccctatccctgatttacccttagagccacaccagggtatgttgaggtgatccagtatatggacagaggaagggaaacagctaagaatgactccagcccccatcctatgcactcacagaagcttcccatatcctcttggagagagaggaagaaagtttttccttttattccttatagtctggctcccactaaaatatgtcaaggcataaagtcttgctattccatcaattttagaggatgtgacaaggggcctttcctttttctcaaaccaaaacggttacagaccctagatattccctaagggaggaagagaaagcttagagagagcagaagaaaagtcagaaggatccaaagtctcatagaaaggcactggggttggctctaggatccttctgattccgaaatctcattgctagccaaacaccaaggatctgtaggaacaaagggagagagataagtatcaattaattctcagtctcaaaaaggatgtgtgtgagggaactggagaatgttacctctgtaaagctaaagaagagtccaacaccccctaggattttcagggcttcgtctgaatgcttaagaaacttttctccacacatctggcatgtggggctctggctcttgcagatctgaggataaaacgtgaagaatgcaaagttgtgaatgtaaagttgctagtgactaatacctatgccgaatgtccctagaaactttactgttatctgaccagtgtcctacaaactaaaatcctacttggctaattccccagcctctatccacccccacctcccaccaacacagccccaatacaagagggcttgtagagagagaaacaatgacattcaaactaaatttgccaacttgggcattgtccttacccagtttcctacctcccctggctgctgcaccacccccaacac

SEQ ID NO: 277 - DNA, 1267 bp, Homo sapiens
cgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 278 - DNA, 1235 bp, Homo sapiens
atggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 279 - DNA, 1164 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 280 - DNA, 1464 bp, Homo sapiens
cgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 281 - DNA, 1500 bp, Homo sapiens
gtgctgggattacaggtgtgagccaccgcgtcctgctccaaagcattttctttctatgcctcaaaacaagattgcaagccagtcctcaaagcggataattcaagagctaacaggtattagcttaggatgtgtggcactgttcttaaggcttatatgtattaatacatcatttaaactcacaacaacccctataaagcagggggcactcatattcccttccccctttataattacgaaaaatgcaaggtattttcagtaggaaagagaaatgtgagaagtgtgaaggagacaggacagtatttgaagctggtctttggatcactgtgcaactctgcttctagaacactgagcactttttctggtctaggaattatgactttgagaatggagtccgtccttccaatgactccctccccattttcctatctgcctacaggcagaattctcccccgtccgtattaaataaacctcatcttttcagagtctgctcttataccaggcaatgtacacgtctgagaaacccttgccccagacagccgttttacacgcaggaggggaaggggaggggaaggagagagcagtccgactctccaaaaggaatcctttgaactagggtttctgacttagtgaaccccgcgctcctgaaaatcaagggttgagggggtagggggacactttctagtcgtacaggtgatttcgattctcggtggggctctcacaactaggaaagaatagttttgctttttcttatgattaaaagaagaagccatactttccctatgacaccaaacaccccgattcaatttggcagttaggaaggttgtatcgcggaggaaggaaacggggcgggggcggatttctttttaacagagtgaacgcactcaaacacgcctttgctggcaggcgggggagcgcggctgggagcagggaggccggagggcggtgtggggggcaggtggggaggagcccagtcctccttccttgccaacgctggctctggcgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgact

SEQ ID NO: 282 - DNA, 1456 bp, Homo sapiens
caatgtacacgtctgagaaacccttgccccagacagccgttttacacgcaggaggggaaggggaggggaaggagagagcagtccgactctccaaaaggaatcctttgaactagggtttctgacttagtgaaccccgcgctcctgaaaatcaagggttgagggggtagggggacactttctagtcgtacaggtgatttcgattctcggtggggctctcacaactaggaaagaatagttttgctttttcttatgattaaaagaagaagccatactttccctatgacaccaaacaccccgattcaatttggcagttaggaaggttgtatcgcggaggaaggaaacggggcgggggcggatttctttttaacagagtgaacgcactcaaacacgcctttgctggcaggcgggggagcgcggctgggagcagggaggccggagggcggtgtggggggcaggtggggaggagcccagtcctccttccttgccaacgctggctctggcgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtatgctctttatcagatacaaaatttacgaacgtttgggataaaaagggagtcttaaagaaatgtaagatgtgctgggactacttagcctccaattcacagatacctggatggagcttatctttcttactaggagggattatcagtggaaatctgtggtgtatgttggaataaatatcgaatataaattttgatcgaaattattcagaagcggccgggcgcggtg

SEQ ID NO: 283 - DNA, 1307 bp, Homo sapiens
cattcccagaagctaagtgtaacttaaaagttttgtgagaatttgttttaacaaacaaacaagttttctctttttaacaattaccacattctgcgcttggatatacagcagtgaacaaaaaaaaaaaaaaaaatctccaggcctaacataatttcaggaagaaatttcagtagttgtatctcaggggaaatacaggaagttagcctggagtaaaagtcagtctgtccctgcccctttgctattttgcccgtgcctcacagtgctctctgcctgtgacgacagctccgcagaagttcggaggatataatggaattcattgtgtactgaagaatggatagagaactcaagaaggaaattggaaactggaagcaaatgtaggggtaattagacacctggggcttgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcaggtgaggactgatgatctgagaatttgtaccctgagagcttccaaagctcagagcattcattttccagcacagaaagttcagcccgggagaccagtctccggtcttgcctcagctcacgcgccaatcggtgggacggcctgagtctccctatcgccctgccccgccagggcggcaaatgggaaataatcccgaaatggacttgcgcacgtgaaagcccattttgtacattatacttcccaaagcataccaccacccaaacacctaccctctgctagttcaaggcctagactgcggagcaatgaagactcaagaggctagaggtctagtgccccctcttcctccaaactagggccagttgcatccacttaccaggtctgtttcctcatttgcataccaagctggctggaccaacctcaggatttccaaacccaattgtgcgtggcatcatctggagatctctcgatctcggctcttctgcacaactcaactaatctgaccct

SEQ ID NO: 284 - DNA, 1197 bp, Homo sapiens
ggaccacaggtgcacgccacgacgcctgggtttgtttgtttgtttaatagagacgaaggtctcaccatgttatctgggctcaagcgatcatcccccctcctcctcctaaagtactgggattacagtcccaagctatcttgcccgacctgggaaacagacgttaaggaagataacaatctattttcagagagcgagtttataaaaccaatgcaatgggtaaatatgaagtgtgaataggaggagaagctaaagagtggtcggagaatctaatgcaagctacgggagaaagaaactcaagtgcaaatgctgcctcaggaataaacgtaaaaagagactttcaagtgcaaatgctccctcaggaataaaataatcttgagactctcaagtgtaaatgctgcctcgggagaaccgaacggcgagctggagcccatacgcaacgagattagagaggaaggcagaagccagagcacatgaataaatgagcatccattttgtttcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgt

SEQ ID NO: 285 - DNA, 1491 bp, Homo sapiens
agaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcatttattgtcaacatttattgagcacctattacaacaatttcatcgcatggaagacagcatcgtttctgacactgttgtttcatgtatctcttagaaaaacgctgctattagacatctaacactatttatcttgaggtgataaaatatcaaaagccgtgtctcaagatcgatgaaatgcggttaaaatgatgaatagaaactctagggggacctcatatcgatagactcgagactggcacatctggagatccgtatttatccggcttccccttccagatcacgcgaggtttgggatattttgctcaccaggcctcagccaggtaactgaatccagccaaccctggcccatagtctcggaatccgactcggctcccagtccccgcctcggcgttctgagacccccaggctggggttccagagggctgtgaggttgcgaatgactgctgccaaaccggaaggaactctgcggttctctgccacagtgggattgttgcaggcac

SEQ ID NO: 286 - DNA, 1500 bp, Homo sapiens
cctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcatttattgtcaacatttattgagcacctattacaacaatttcatcgcatggaagacagcatcgtttctgacactgttgtttcatgtatctcttagaaaaacgctgctattagacatctaacactatttatcttgaggtgataaaatatcaaaagccgtgtctcaagatcgatgaaatgcggttaaaatgatgaatagaaactctagggggacctcatatcgatagactcgagactggcacatctggagatccgtatttatccggcttccccttccagatcacgcgaggtttgggatattttgctcaccaggcctcagccaggtaactgaatccagccaaccctggcccatagtctcggaatccgactcggctcccagtccccgcctcggcgttctgagacccccaggctggggttccagagggctgtgaggttgcgaatgactgctgccaaaccggaaggaactctgcggttctctgccacagtgggattgttgcaggcacgcggctcagacttcactgaggttgggagatgctcctgtccacgctgcctcatcccgtgctggagcactgcacctctatttttttttttagggtacacgccacataacataaaactaaaaattttaaagagtagaattcagtggcatttagtacaatgttatgcaaccatcactcctatctagcccaaaacattttcgtcaactgcataggaggccccattaagcatacctgttaaactcttcttgcctccaactcctggcaactacaaaactccttttgtctctatggatttacctattctgaatatttcttataaatgggatcatacaatatgtgaccttccgtgtctggcttctttcaccaagtgtagtgttttgggggttcattcctgctgcagcatgtatcagtacctcatttcattttatggctgaatcatattccattgtatgaatatactggaaattgctcgtctactcatccagtgatgaacatcgagttgt

SEQ ID NO: 287 - DNA, 2591 bp, Homo sapiens
cggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 288 - DNA, 1862 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctggaaaa

SEQ ID NO: 289 - DNA, 1775 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctggaaaa

SEQ ID NO: 290 - DNA, 1991 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagaggtgtgaggcaccatccccggccagtttgcagtctaaaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctggaaaa

SEQ ID NO: 291 - DNA, 1500 bp, Homo sapiens
ggcctcgcccacaatattaagcttttcatgctttactccctaatctcggatcacacttctgcagtcctttcttaaatacatcaacccaactttaaaccttactcaccctattcattcaagtcttccagtctcccaggccctgcccctcaagtaccctttcctcaagttccgcccctcgacttctccttccctttcccgtaggtaccgcccctcaaatctccctcccctctagcctcggcccccctatttcctctaacttcagcgcccgcccctccagtcccgttcgtctcccttctccacacctcaacgttgcttccctcagtccccgcctctcaatttcctcctgagaaatcaagacacttctctcacgcctgctctctagacctccgcccccccatcagtcccgccttctcttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtgagtcatatggggaacttctgttgggtgtttggtggttcgaatcccatcttaagcgttttgtgcgaacggagtctcctgagcttcgctttgtctgtagttttgagctgaagggggagtgtgtgggcgactctcttccttttcagtagatcatcctcgaggtgaagttcacttcccgtattacttgcaagctgaaacaggcctgaacatacaggataagaagaacagcgttgtattcttcaatatcagagcgaagtgacttcgtaaaaattctatagatgttagaaatcgttgccattctttaggttcaatctataaaatacttatagagaagccagtcttagctactgggcgctgcagggactggaaacgcactgagctgtgtaggaggatgttctgcgtgtccctaaataagtccctaagtaaatgtatgg

SEQ ID NO: 292 - DNA, 1066 bp, Homo sapiens
taccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtgagtcatatggggaacttctgttgggtgtttggtggttcgaatcccatcttaagcgttttgtgcgaacggagtctcctgagcttcgctttgtctgtagttttgagctgaagggggagtgtgtgggcgactctcttccttttcagtagatcatcctcgaggtgaagttcacttcccgtattacttgcaagctgaaacaggcctgaacatacaggataagaagaacagcgttgtattcttcaatatcagagcgaagtgacttcgtaaaaattctatagatgttagaaatcgttgccattctttaggttcaatctataaaatacttatagagaagccagtcttagctactgggcgctgcagggactggaaacgcactgagctgtgtaggaggatgttctgcgtgtccctaaataagtccctaagtaaatgtatgggatagggtggccagaagtgggtaggagggcatcagtcctccttcggacttaggttttctgcttgaa

SEQ ID NO: 293 - DNA, 1325 bp, Homo sapiens
tcactatgttggccaggctggtcttgaactcctgacctcatgatctgcccgtcttgtcctcccaaagtgcgggactacaggagtgaacccccgcgcctggccccctgtatatatgaaatttaaatgtagtgttgattgtatcagtacatttttggtttcagtcttaatttaaaagaattggacaaatgtaagcttttatgagccccccagctcaattttattgctttttacttatttgtaaccttcagataatttgtttttccctgtagtttatggctgtcagataaaaaactgatctggtgacaatgatctggtgaaaagctcagcccagaagaactataggtctgggctgttaggacttttaatttttggagagcatgtttgccctgtttttttttttttcttttcttttgctgttgtaataggcccatcatttactttttaattttaagtcttgtgccttgaaactcacctttgttgttggacactttctttttgaggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttggtaagaccctttgttgtatagtatcacgttttgttcagaaaaacacttacagaaagttgtattaccaggtggaaggttctgattggagttgtccaggtttttggcacgttgaacaaataattgaacatcatgcatgaacaagcaatgaaagcatagatttattgaagtggaaggcaatagaagctaaagtacatgtcacaggatgggagcaggcctgagcaagtggctgcagagcccttgtagcaaagtcttctggggttcaagtaccctctagaggtctcccactgtttacatcctatgtaaatgaagtgctggctcacagcccattagaggccaaagtgaattggagctcggccattccaagactggtgtggattgacgccttatgcaaatgaaggtcctagaatggacggatcataggccagagtgcaaattcttccttttttgtttagtttcaggaatttttttttttttttttttggcaacggagtcttgctctg

SEQ ID NO: 294 - DNA, 1129 bp, Homo sapiens
tgtattcttggtggagatggggtttcatcatgttgcagtctggtctcaaactcctgagctcaagcaatacatccatcttggcttcccaaagtgttaggattacaggcataagccacagtgcctggcctagttttagctcttatgtttaattaaggtcctttattcattttaagttttatttatttatttattgagacggagccttgctctgtcaccaggctggattgcaatgtcatgatctcggctcaccgcaacctcctcctcccggtttcaagcgattctcctgcctcagcctcccaagtagctgggattacatgcttatgccaccatgcctggctaatttttgtatttttagtagagatggggtttcaccatgttggccaggctggtctcgaactcctgccctcgggtgatccacccgcctcggcctcccaaagtgctgggattacaggcatgagccaccgtggctggcctaacttttttatttttattttttgtagagacagagtctggccatgttacccaatctgatcttgaactcctgctgtcatctgatcctcctgcctcagcctcccaaagtgctgggataagaggtgtgaggcaccatccccggccagtttgcagtctaagtatgatgttagctgtgggtctttccctttccctttctctttcccttttccttttcctttcccctttcccctttcttttttcctttcctttcctttcccttctgctttcctttcccttccgctttcctttcctttcccttccgctttcctttcctcccctcccctcctctcctctcctcttttctttcctcttctctctcctcttctctcttcctctctcctttctcctctgatatctgaagactaagctgtggatgtttcataaaagttctttctggggtgggtgcagtggctcatgcctgtaatccaagcactttgggaggctgaggtgggcggatcacaaggtcaggagatcgagaccatcctggccaacatggtgaaaccccgtctctactaaaaatacaaaaacaaaattagccgggcgtggtggcaggagcctgtatttccagctagttggtgatagagtgagactctgactcaaaagaaaaaaaaaatgcttt

SEQ ID NO: 295 - DNA, 1125 bp, Homo sapiens
gcgcagtctcagctcactgcagcctcgacctcctgggctcaagcgatcctcccacctcagcctcctgagtagctgagaccacagggacccaccaccacaccctgctgattttttattttttgtagagatagggtttcaccatgttgcccagactaatttttaaattcttggtagagatgggtgccccctatgttgcccaggctggtcatgagctcctggggtcaagtgatcctcctgccttagccttccaaagggctgagattacaggtgtgagccactgtgcctggccatgtggttatagataaactgccatttgttaaactcattggtaatgttgttttttctctcctaatttttaatcttgtaaaatcttgataagcagattgataattctgattgccttcttaggctattttcctacaattagcatttatgagcaatttttaaacgtttgatacatgaaattcaacagccctctgatgcatgcttttatattacagaatgtgtgaatgacaactactggtttgggagggacaaaagctgtgaatattgctttgatgaaccactgctgaaaagaacagataaataccgaacatacagcaagaaacactttcggattttcagggtaggtaatgaatacccatgtatctaggagagctggtaatttggtcattgtttttagatattttcccactataaatctctgctattcaaagtctgaaacaaaatgttctctattttaggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaaggtaatattattatcttatggttactggaattttttttttccactctctcataggaggaaaatttgtcctgtccttacagaatatggtttaagtgagtaaagatgagtaagttgctgggcgtggtggctcacacctgtaatcccagcactttgggaggctgaggcggatggatcacctgaggtcaggagttcgagaccagcctgacccacatggagaaaccctgtctctactaaa

SEQ ID NO: 296 - DNA, 1148 bp, Homo sapiens
ccttccaaagggctgagattacaggtgtgagccactgtgcctggccatgtggttatagataaactgccatttgttaaactcattggtaatgttgttttttctctcctaatttttaatcttgtaaaatcttgataagcagattgataattctgattgccttcttaggctattttcctacaattagcatttatgagcaatttttaaacgtttgatacatgaaattcaacagccctctgatgcatgcttttatattacagaatgtgtgaatgacaactactggtttgggagggacaaaagctgtgaatattgctttgatgaaccactgctgaaaagaacagataaataccgaacatacagcaagaaacactttcggattttcagggtaggtaatgaatacccatgtatctaggagagctggtaatttggtcattgtttttagatattttcccactataaatctctgctattcaaagtctgaaacaaaatgttctctattttaggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaaggtaatattattatcttatggttactggaattttttttttccactctctcataggaggaaaatttgtcctgtccttacagaatatggtttaagtgagtaaagatgagtaagttgctgggcgtggtggctcacacctgtaatcccagcactttgggaggctgaggcggatggatcacctgaggtcaggagttcgagaccagcctgacccacatggagaaaccctgtctctactaaaaatacaaaataagccgggcatggtggtgcatgcctgtaatcccagctattcgggaggctgaggcaggagaatcgcttgaacccgggaggcagaggttgcagtgagccaagatcgtgccattgcactctagcctgggcaacaagagtgaaactctgtctcaaaacaaaaaaaaagatgagtaagttagcactcaagattcaactttgccgtcctagttgcattgtaaaattatgaaaaagttccatccagacagatttttaaggttt

SEQ ID NO: 297 - DNA, 1091 bp, Homo sapiens
aatacttaataccggatatataaaggtataaatggctgagagatgataatacccgtatggtgatactgatggcctaattttcattgggatatttacttgcctagaccattttttctaggctcagactgatggattgctttttgattctgggcctgttgtaaatctgcatgggcattttatattagtgtaattgattgatattctgaggtcaaggaatataaataatgttgtgttacggattttttgcactagtttcagagtgatgcttatagttccattgaagcatgaaatttgactatcatttatttctcaagggctttacaatatgtattagcccactaatacctattatattacatacatactaatttccttaaggttacatgttaaatgtagttaaaaacagttcttatattccatatgatgaataaattttagaatcagtgatcgcctcttgtgaataaattaatgaaacccatttctactcttttcttccttagtttttgtcttttttgatctgactgtagatgatcagtcagtttatcctaaggcattaagagatgaatacatcatgtcaaaaactcttggaaggtaaattattttcttatataaatgcacttaattttttcactatacatttgtgattggtggtttctcatttctgattttataacactcattatgtattgataacatttgtatggtatctatttgtgtattattttttatttttatttttgtgtgttatttcacacagtcattttaatttatttttattttatttctttgtgagacagggtgttgctctgttacccaggctggagggtagtggcacgatcagagctcactgtggccttgatctcccaggtcaagggagatcaggcatgcagcaccatgcacaactaatgtgtgtttttgttttttagagttggggttgcgctgtgttgccagggctggtcttgaactcctgggctcaacccatcctcctgccttagcctcccaaagtgctgagattagtagcgtgagccaccatgcccagccaaatatttctttttttatttcctgtgtgtgtgtgtgtgtgtgtgtgtgtg

SEQ ID NO: 298 - DNA, 1109 bp, Homo sapiens
atttgatttagggtgcaacttatgtcatcaactgcttatgcacttcctttgaagatggagaataagaaggaaagaaatttatccattaaagttattcatttgcagattctgtttaccgttatttgtttgttttgggcacttatttttgaccagggaggactgtttctagttaatgtttttctgacctctcggatacgtagtttctctctcatttttctcttagtatctttctgggaatttcacaatccagggctacagtaagacccatgtttgtattgctgggctcagaaatggaatttggagctgacttagtgtttttggctgttaagcccttgacattttacactggtgaagtttcactgtgtcctctgcaaacagggacaatggaaaggctgttatatggaatgtctgtaaattctaatacttgaagtggacccaggagtggtaggtctcataattaaaaacattcagacaatcactatctttgtttttccctctagtggtgcctgtggagaggtaaagctggctttcgagaggaaaacatgtaagaaagtagccataaagatcatcagcaaaaggaagtttgctattggttcagcaagagaggcagtaagtaccaataaaaggctgatcaccttttattaacacgtcttcataacttcccaaaataatcttagattgatgatttttaaactcaggaataaccccctgcttagatggatgaatttgtgagtatcaaagaacatggaaaattttggggcatctttgattaatctagaaacttttacttatagataatttggttccaaaagtatttaattgtacataataatgagcatagtgggaagtttttttttttcttcttccaagttcaaagtcgttacaagattgtttttacaataaatgacaggaaattagagaaaaaaattcagccataatccccactgtaaccccacagctgttttcagttttccttttccttctagattttgttcagatgaaatcgtgtttttagatggttgaaatcatcttgtatatacagttttgtattttgcttttccacaaatgcattatagcatagacttttgcctaatacatcctttttgatg

SEQ ID NO: 299 - DNA, 1054 bp, Homo sapiens
ctctattagcagaaatttgacttcacattttctttatatagtttaattgaacaccttcttgttcatgttttttgtttatcattttaatgaataaaaatagttccatagctaataagtagggtttactaattaaaatgaacacagtggaaacacacttgtttctgactgtggagactagggcaagtggcttctgttttctgagccttggttgccccatctgtaagatggggattctgaggcttatgagacatgatctctgtaaataaagagcttggcacagggcctggccatttattgagtgcttactatttgccaagcattttacaaagttattttaggtgaggtatttaagtcattgacctgggctttgatttctttgtataagtagagctgggtttggaactcaggcagccttgagtcaactgagtttaactgtaaatgtttttttaaatattggcaattattattactaataaactctgttattctgtttatcaaaggacccagctctcaatgttgaaacagaaatagaaattttgaaaaagctaaatcatgtaagtattattatatgactcatacttagatttatctatctcaaaatatgagaagagtataaagcctttcagtataataaagataatattggccaggtgtggtggctgatgcctgtaaccctagcactttgggaggccgaggtgggtgaatcacctgaggtcaggagtttgagaccagcctggccaacatggtgaaaccctgtctactaaaaatacaaaaatttagctgggcatggtggcacatgcctgtaatcccaactacttgggaggctgaggcaggagaagtgcttgaacctgggaggcagagattgcagtgagccaagatcgcgccactgcactccagcctgggcgacagagtgagactgtctcagaaaaaaaaacaagaaaaattaaaagaataaataaagctaatattaacctgggttctttaacttatgtgtacattcacacacatgcctagctgtcatttagctgggaagagttttaccccaaaatgttac

SEQ ID NO: 300 - DNA, 1062 bp, Homo sapiens
ttagaattttcctcttcctttgaaaaatggtaggatcttgttccatggggtccaattgcctggaggttccagttgcccagagcttaaataacccttgtttggcagcatggctgggctcctacttgacagcttttattcatgctacttgtcagtctccctcagggttccttaggctgtccttgagtacctctgctctggggtagtgaggaagaagactgggaagagacctagccttcattcccaggtagcatccttgcatatgaaatatgaactagtctctcaccatcatggtggggtggaaaatttcttgcatgttctcactgaggagttggctagattctgtctgccttctcccctgattgaacttccaagcctctgaggcagggggccagatgcctgttcttggcctccctgtccctctgggcagatgttctaagctcttgtggttttcctcttgggagtttctcactactttcccttttttctccccctcttcttagccttgcatcatcaagattaaaaacttttttgatgcagaagattattatattgttttggaattgtaagtagtaaactttttaaaaatttctgtttccattcaaatgctttataaagccaccaaagaatctaatgtaggcttgcctttctcatcctggggggcctcaacgtatgtatgtagtagtggggcccacaaagtctgtgtatagggggttaatatcaacccaaaaaaccctccaatgtttccaaaaataggtggtatgggattccaggtcctggatctatgatcaggacttgaactccactctgcagttgactagctgaccacccatgggtcagtttaactcacttttctgagtctcatcttcatagtgttaaatggggattataatgaacccccacatgcagagtccttgtatgaattaaatgctatgagggatggaaatcccccagcagagcacctggcacatgtgtgtactcaccatggggcaatattgttataattggctcaccataactgtgggtttttacatccgtgtattcaaccaacctcagatcgaaaat

SEQ ID NO: 301 - DNA, 1100 bp, Homo sapiens
tttgagaccaacctggccaacatggcaaaaccttgtctctactaaaaaaaatacaacaattagccgggcatggtggtgcatacctgtaatcccagctacttgggaggctaaggcatgagaatcacttgaacctgggaagcggaggttgcagtgagccaagatcgcaccactgcactccaacctgggtgacagagcgaggctctgtctcaaaaaaaaaaaaaaaaaagcaactcctgggccccacttccaagctactgaattggattttttaaagttccccaggtgcctccaatgcccaatcctttcatctcattccttagtttccaactgggacatctgattgtgaataaaccttattagttttaaaaatgagagtcaaaagtgaataaaaatgtcaactgtttgcttgtcttaatgaatttgttttgttgttttattgtcttctgtccaagtgcgttttcccccaggaatgaaccccttgccttgcctttgtgtttcaggatggaagggggagagctgtttgacaaagtggtggggaataaacgcctgaaagaagctacctgcaagctctatttttaccagatgctcttggctgtgcaggtaaaagaagccctcaattcttttgacagctgcctttcttttagttgaattactccctgaattaggcagaaatcgagggaccgtggattaaaactcagaagagaatctgtgtgtttgctgttctcttcttggcaaaaatgtcctactcctttcactgagatgaaaaagctctcactggcgaggcgcggtggttcatgcccataatcccagcattttgggaggccaagcgggcggatcacgaggtcaagagatcaaaaccatcctgaccaacatagtgaaaccccatctctactaaaaatacaaaaattagctgggtgtagtgttgcgtgcctgtagtcccagctactcgggaggctgaggcaggagaatcacttgaactgggaggtggaggttgcagtgtgctgagatcatgccactgtgctccagcctggggacagagtgagactccatctcaaaaaaaaaaaaaaaaaaaaaagaaaaagctctcactgtgtagctta

SEQ ID NO: 302 - DNA, 1087 bp, Homo sapiens
gacaaagtctttgcattgaggaataggttaactcacataaacagatatatatttgtatcacataaatagatatttacaaatatatatttgtataggttccctttaaaaatattctcaggactgcaataaccaaatatatcattttggtggaatttttgtgtttatttggtatgttctcaaaacattttctgttacccatttgaatttttattgaaattgacaccttacatttctgctgtgtgaagagttgtttattatcttaaagtgaaatgaaaggttaattgttctaagttgcttttttcatttccctgctttttaaagatcttctcaaacaaatttgtaaactttaccccaacagttttctatgattttggagaatatggttgtgtgtatcacggcttacggtttcacccagctgtgagatgtgtgtgttggtaactttgattctacttaagtatctactgcatgaatctgagggtcatgcctgcctttctgtgtagtaccttcatgaaaacggtattatacaccgtgacttaaagccagagaatgttttactgtcatctcaagaagaggactgtcttataaaggtaagaaattggcattctgtatgtggctattcctgtagattcttgttcagaaacttttaattcctcaaataaaaagtgggagcgtaaaaaggatgagaatctgaccctttcactgttaccaattattttagagatcaggtgatactgctcttatccagattcgaatgagcatttattgagctctgttgtgtacaagtgacctttgtgcttagagagagaggaggggtctaaatggacgagtgggctgggtatggtggctcacacctgtaatcccagcactttgggaggccgaggtgggcagatcacctgaggtcaggagtttgagaccaacctggccaacatggcaaaaaatacaaaaatttagctgggcatggtggtgggtgtctgtaatcccagctacttgggaggctgagacacgagaatcacttgaacctgggaggcagaagttgcagtgagctgagatcgcaccactgcactccagcctgtgcaaaagggccaga

SEQ ID NO: 303 - DNA, 1164 bp, Homo sapiens
aatgagtaatcacatgcgctgcctttccctgtttctcaagtctggcatcactttagaatctcttgttaggatttatgacacccaggctttacctcagaagctgagagtggcactcaggtataagcatgtgtttccaagctccccaggtattccatagcgcagccaagtttgagacactggggtctaagaaccatgtagaactaattagaatcctgaagtgtctgtgataaagataataagctttttgtaagattacagaggacataggttaagttggaaagcctgagtgttgagattcctaggctcaggaattttaatttaagcaaaattaaatgtcctaacttgcaaagacatgaatctgtaaattccagattaatggcaggtgtgaattgtacaatagaaactgatctagcctacgtgtcttcttggactggcagactatgttaatctttttattttatggcaagttcaacattattcccttttgtactgaattttagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctggtaagaaatattttcattgctgcacagactggtaggaggtgattagatgaagtcacaaatgtgtcttgctctgttgtccaggctggcatgcagtggcttgatcttggctaactgtagcctctgcctcctgggtcaagtgatcctcccacctcagcctcccgagtagctgggactacagatgcacaccaccatgcccagctaatttttctattttttgtagtgatggggttttgccatgttgcccaggctggtctcgaactcctgggctcaagtgatcctcctgcctcggcctcccaaagtgctgggattacaagcctaaggcattgtgcccagcctagctcactttttgaccattgatttaaagaaaaatctgacttttcattatgctgaaaaagaaatctttatatctgaatgccactgagaatgccacttgatttcttttcctttctctctctaccaatattaagccttagtgggtatccacctttctctgagcatag

SEQ ID NO: 304 - DNA, 1116 bp, Homo sapiens
ctgctggagtttaggagttattctttttatctggtaagaaatattttcattgctgcacagactggtaggaggtgattagatgaagtcacaaatgtgtcttgctctgttgtccaggctggcatgcagtggcttgatcttggctaactgtagcctctgcctcctgggtcaagtgatcctcccacctcagcctcccgagtagctgggactacagatgcacaccaccatgcccagctaatttttctattttttgtagtgatggggttttgccatgttgcccaggctggtctcgaactcctgggctcaagtgatcctcctgcctcggcctcccaaagtgctgggattacaagcctaaggcattgtgcccagcctagctcactttttgaccattgatttaaagaaaaatctgacttttcattatgctgaaaaagaaatctttatatctgaatgccactgagaatgccacttgatttcttttcctttctctctctaccaatattaagccttagtgggtatccacctttctctgagcataggactcaagtgtcactgaaggatcagatcaccagtggaaaatacaacttcattcctgaagtctgggcagaagtctcagagaaaggtatgaatatgaaagggttaagaatttgtggtatgctaaaatgtgtatgtgctgtggtgggagtttcttcccaaattccatggtgttttctcctgtcaattctgttcttattttctattgttagtttcacaccatttgagaggcactggaaattattaagagcatgcactcaggtcctgggtctgctactacttagctgtgtggccttaggcaagttatttaacctccatctccaatttctttctgtgtaaagggaccctcaataaaccctaccttaaaaggtttttgtgagggttaagtatcatgtacacaagtgcctggtacctattttagtgagcaaaataaatgcacttgtaactttttagttacaaggtttcctttgagtaagcaagcatgtaaaaactagatgtcattagttaccttgtattttataatttatcctggcaactttagttccctgaagagaaagtagaaaattaaatgtcaaataacataacata

SEQ ID NO: 305 - DNA, 1086 bp, Homo sapiens
gttaaatgtcagaatatttaaggaataataatgttgtaatatacaggccagcgtgcatttgttgcttgctggagtagccaagttttatttctgacaagtctgcagttccagggagcctctccctcgctgagtaactgtcacctatccatctgtagatgtcagagagagtttgctgtgcatcccaagtatcttagaattgggtagaagtttagctttaattagtccgaccttgagtctagcaacaagagagggaacaggcagtgaagaggtcgtgactgacgtcccagcagcaggagacagggagtgtcattatcattcctggtcttctcacagtactctgaatacagagagtgaggaagattagggggccctgtctgctgactccgtgatgatctcagaccctctctgctctttctgaatggtggcctgttaattctggcatactcttactgataatatatttatccttttcactgtgatttgcccaattgttgctttagctctggaccttgtcaagaagttgttggtagtggatccaaaggcacgttttacgacagaagaagccttaagacacccgtggcttcaggtgggtgtgggacagtgcctgctagcataaaatacatgggaagccctgctgcctgagagacatgagacagaggacagaaacatgtttactttgttgagtgtttaatctaattgttttagatgtatggggggtatcttggaggatgggttacaacctgttttatttttttttttgagacaggttcttgttctgtcaccctggctggagtgcagtggcacgatctcagctcactgcaacctctggcccccgggttcaagtgattctcctgcctcagcctcccaagtagctgggattacaggtgcatgctgccatgcccagctactttttgtattttttgtagagatggggtttcgccgtgctggccaggctacaacctttttgatattactcatggctgttggatgtacacgctcactttatgtcctgttctggttccacttggctgccccgagtctcctgtttggcctgtgttcttttgagtgcttgttctggctctaccc

SEQ ID NO: 306 - DNA, 1081 bp, Homo sapiens
gtgggcttaagtacttctgaaaatttgtatggcatctgctgggtgaattttcctagggtgctgggctggttgttaggacagtctgggtgactggcctcattcatggcaggggcagcaggtggagagtggtccgggaaggatttgaggagctgcacggagtcaggcccagcctctggcctcctgattgccacctttctcaggatcttggatactaattaagaaactcttgactgctggaggctgtgattgacccactgagagcttttaggcatgtggatgtgagtcagccaggattgatggagcattgactgctaattagactcctctgggaaggtagaggcgggcaacacataatgccttcgctgtgggagcttcatcaaggggatgattcttggacggacatttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctaccccaggttctagcccaggtattcgtattcctgatgatcactaaatgtagtctgggcttaaggagctgataagcaaagatgatgaaattcaagattttcctgagtagcaattgcttaacattgtttcagttataatgtagtagaaactctgttttaacttgattcgctccagcacccttagatttaaaaatgcaggatatgtttaatatctaacacataatagaccgataagcacagctagggattgtcatccaaaaggtcacctgcaaggcaatttcgaaagactctattagaggctcaaatataaatttgttgaacaaattaaaatttgggtcagtagttgattccttgattacaattttattctttaaagttctttgtgagtataagttaattccagtcctgcttttttgttgttgttgttgttgttgaatggtagctgtcctttttcccactgtttcctccccccaattttttttttcttgagacagagtcttggtttgtcactcaggccggag

SEQ ID NO: 307 - DNA, 1244 bp, Homo sapiens
atgttggtcaggcttgtctcgaacttttgacctgaagcgacctgcccacctcggctttccaaagtgctgggattacagctgtgagtcaccgcacccagccttcctcccaattttatatatgggaaaacaactaaggcacaaaggttgtcttcccgcaaaagaccaagacttggggcttcaactgagaggtattatagtccttttaaacttgatatttagaagaggacgatcaagaggaagttggttatgctacttgctttcagtatacatcgttcagaggtcagaagccataagggagagaaatatctattagataagcatgtctgagttgggggctgtggtgaggactcagttgtcaatgatgacaaccagtaatttttggttctagaatttcacatcaaatgcccccactttactggaagcatattgaggaactttgataatcttaaagaagccagtgattttcttttgaacatttctccattttcctttattttcagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggctttgtgcttctgcttgataatcggttctttagttgaatggctttattatttatttatttgagatggagtctcactctgttgcccagcctgaatgaagtgcagtggtgcaggcttggctcactgcaacctctgcttcccaggttcaagcgattcttgtgcctcagcctcctgagtagctgggattacaggtatgcaccaccatgcctgttaatttttatatattttgtagagacagggttttgccatgttggccagcctggtcttgaacttctgacctcaggtgatctgtctgcctcagtctcttaaagtgctgggattacacgcatgagccactgagcctagcctgaatggcttttttatatttaaagttgtgtgcctttcatctggagctacaccttggctatcactaggcaggtttcccaggatgtcaccctggtctcagcctgtgagagctgaatacaaattctaagggccccttggaaagttccagggaaggga

SEQ ID NO: 308 - DNA, 1500 bp, Homo sapiens
ttatgctacttgctttcagtatacatcgttcagaggtcagaagccataagggagagaaatatctattagataagcatgtctgagttgggggctgtggtgaggactcagttgtcaatgatgacaaccagtaatttttggttctagaatttcacatcaaatgcccccactttactggaagcatattgaggaactttgataatcttaaagaagccagtgattttcttttgaacatttctccattttcctttattttcagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgggctttgtgcttctgcttgataatcggttctttagttgaatggctttattatttatttatttgagatggagtctcactctgttgcccagcctgaatgaagtgcagtggtgcaggcttggctcactgcaacctctgcttcccaggttcaagcgattcttgtgcctcagcctcctgagtagctgggattacaggtatgcaccaccatgcctgttaatttttatatattttgtagagacagggttttgccatgttggccagcctggtcttgaacttctgacctcaggtgatctgtctgcctcagtctcttaaagtgctgggattacacgcatgagccactgagcctagcctgaatggcttttttatatttaaagttgtgtgcctttcatctggagctacaccttggctatcactaggcaggtttcccaggatgtcaccctggtctcagcctgtgagagctgaatacaaattctaagggccccttggaaagttccagggaagggagcatagcgaggttgggggtggagtttgtagagactggctggctggctgcagacatcttcatgagaacagcaggtaccttggtgcatgataacaggccaggttatattctcatcctcgccctcataaagatacaggtctaccgtctctgaaacctttgggctagataagttgtgaaatttaattatccaattttaggaaggtggtaaggcatatctactatgtgtatgtgtagcaccccagtggagtcctacacatgtggagtcctaccccagtggagaccaaacatgttaatatttccacagcaaatattcacagtaagagggatagagaaagattataggtagttgcatattggttcatatcagtcttttcttccaaatgagctacaatgacttgtttttgagagctgtttgggttttggaagtggagataaggcatgtggttatgtcttgttgacccaataatgaccagggaggccctgtgcaaagacttacccttgg

SEQ ID NO: 309 - DNA, 3814 bp, Homo sapiens
agctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttaaaaaaaaaaa

SEQ ID NO: 310 - DNA, 3811 bp, Homo sapiens
agctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttaaaaaaaaaaa

SEQ ID NO: 311 - DNA, 3694 bp, Homo sapiens
agctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttaaaaaaaaaaa

SEQ ID NO: 312 - DNA, 1500 bp, Homo sapiens
aactgatatccctttcagtgagaaatcctcattagctacataagaggggactgggtgtttttttcaaaaagctggtattgggacatctacctctgtgatgtccctggtcagctatattgtctaggagttgaaacattttgtattaattttctatcatttactgggtgcctcttctgtgacagtgccactcaaaggtctattgatatattatcaggtgactgaattctatattctgaagtaggagatactgttattgctgttattacattttacacataagaaagctgaggctctgagaggtcaagatcacgcagctaacaaatgagccaagactcttgctttagagcttgtcctctattcttgcttttctttccaaaaaacactacaatttttgttttgttttgttttgttttgagacagggtctcgaggtgtcacccaggctggagtgcagtggcgcgatttcgactcaccgcaacctccgcctccgcgcttaagcgattctcctgcctcagcctcccaagtagctgggactacaagctcgggacaccacgtaaaaatgatcaagttctaacatgtatgcatacgaattacaatggaaataaaattagcaaagcgcttatgctaatgctcaatacaattgatttcctcacatttaatcctcacaaccactacaaccacctctaactcaagctctgagggactgacgtgcccggaggacacagctcttatctggtgagaacaggagcgttttagcgaaactccaaactcctaggtcccgccttccccaggaaggcttttcctggcactgtgcttccggaagtcccgccccaggagaaaaacagcttccggaaaaaattgcggccggcaaaccggaacagaactaggggcggggccgcttgagacgctctagtattcctctactctatggccactgtcaattgacaagtcccgagcggtaaagctcctttctattggatgagcagcctcgcgtaggcgggaagctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtcagtcaacgagccacgccccgtcccgctgggccctcagtgcggcgcagcctctgagcatcggggcacctcccagggcttcggcttccctgcttcacacatgtggttcactgttgcgggggttcgtggagttatggt

SEQ ID NO: 313 - DNA, 1362 bp, Homo sapiens
tctcctgcctcagcctcccaagtagctgggactacaagctcgggacaccacgtaaaaatgatcaagttctaacatgtatgcatacgaattacaatggaaataaaattagcaaagcgcttatgctaatgctcaatacaattgatttcctcacatttaatcctcacaaccactacaaccacctctaactcaagctctgagggactgacgtgcccggaggacacagctcttatctggtgagaacaggagcgttttagcgaaactccaaactcctaggtcccgccttccccaggaaggcttttcctggcactgtgcttccggaagtcccgccccaggagaaaaacagcttccggaaaaaattgcggccggcaaaccggaacagaactaggggcggggccgcttgagacgctctagtattcctctactctatggccactgtcaattgacaagtcccgagcggtaaagctcctttctattggatgagcagcctcgcgtaggcgggaagctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtcagtcaacgagccacgccccgtcccgctgggccctcagtgcggcgcagcctctgagcatcggggcacctcccagggcttcggcttccctgcttcacacatgtggttcactgttgcgggggttcgtggagttatggtgggtgggaaatccgagattctttgcatccatgtgatttctgcggatctgtgaagaacttcaggcctgggtctgagcgtccttttcccaacccttgggccccggcctggctgtcagcactttcggagctccaccctcttccgtgcaccccaaggccagtgtgtcgttgttagcgtgtggggtggacagatctggtgtgtagccggtggtggagaaaggactcattttgtcctagcacccacacacacaggcccccactcctctccacctctgctaaggagggctcaaaacccaccagcataaatgtggctcggtagtccaacgtggacttttaatttttttttcttttttttttttccagagt

SEQ ID NO: 314 - DNA, 1051 bp, Homo sapiens
cggcttccctgcttcacacatgtggttcactgttgcgggggttcgtggagttatggtgggtgggaaatccgagattctttgcatccatgtgatttctgcggatctgtgaagaacttcaggcctgggtctgagcgtccttttcccaacccttgggccccggcctggctgtcagcactttcggagctccaccctcttccgtgcaccccaaggccagtgtgtcgttgttagcgtgtggggtggacagatctggtgtgtagccggtggtggagaaaggactcattttgtcctagcacccacacacacaggcccccactcctctccacctctgctaaggagggctcaaaacccaccagcataaatgtggctcggtagtccaacgtggacttttaatttttttttcttttttttttttccagagtctacaataaaacatctaattggtgtcagagagtttacagaataaaaccttctgaatgtcttgtgtaatgtttgtcttgtaggtatctcttcaactgtggagaaggcgttcagagactcatgcaggagcacaagtgagtcagtctcttgctttcggagggggagttgattacggggcttgaaagccgaaatgagaggccagttgttttttatagcaaaagtggtccttgttctgttcatgttatcctgtttaaatgttttttcattcttaggttaaaggttgctcgcctggacaacatattcctgacacgaatgcactggtctaatgttgggggcttaagtggtgagtatattctttgcagtgtcagaggctggtgggaagtctctgggattttaaccggctttaccatttttccaagtctggggtgggcagctacttttttttttttttttttttttgtcagtggcgtgatcttggctcactgcaacctttgccttctgggctcaggtgatcccctcacctcagcctcccaaatagctgggaccacacgtgtgccccatcacacctggctaattttttttgtatgttttgtagcgacggggttttgctatgttgcccaggctggtctcaaac

SEQ ID NO: 315 - DNA, 1071 bp, Homo sapiens
cctcttccgtgcaccccaaggccagtgtgtcgttgttagcgtgtggggtggacagatctggtgtgtagccggtggtggagaaaggactcattttgtcctagcacccacacacacaggcccccactcctctccacctctgctaaggagggctcaaaacccaccagcataaatgtggctcggtagtccaacgtggacttttaatttttttttcttttttttttttccagagtctacaataaaacatctaattggtgtcagagagtttacagaataaaaccttctgaatgtcttgtgtaatgtttgtcttgtaggtatctcttcaactgtggagaaggcgttcagagactcatgcaggagcacaagtgagtcagtctcttgctttcggagggggagttgattacggggcttgaaagccgaaatgagaggccagttgttttttatagcaaaagtggtccttgttctgttcatgttatcctgtttaaatgttttttcattcttaggttaaaggttgctcgcctggacaacatattcctgacacgaatgcactggtctaatgttgggggcttaagtggtgagtatattctttgcagtgtcagaggctggtgggaagtctctgggattttaaccggctttaccatttttccaagtctggggtgggcagctacttttttttttttttttttttttgtcagtggcgtgatcttggctcactgcaacctttgccttctgggctcaggtgatcccctcacctcagcctcccaaatagctgggaccacacgtgtgccccatcacacctggctaattttttttgtatgttttgtagcgacggggttttgctatgttgcccaggctggtctcaaacttctgcgatcctcctgtctcggcctcccagagtgctgggattacaggcatgagccaccgcacctggcctggaattctttttataccagcccagtcagcagcagcacagagcattaaaagctgtgactcaggagaacagattttaatatggataccacctcttaagtgttaccatccacttagtttcttgcgttgcggggacagagattt

SEQ ID NO: 316 - DNA, 1065 bp, Homo sapiens
gtgattacagttaatatgtttaccgcagacgccattggcacattggcagccacacacatacccactgtccagattaccctgtcatttatgtctatcaaccggaaggtcaggattgtgttgcagccaaattgtgtgggcttggtggcatggaccggaaggagtgaagtgttagaccagtctcccttctcagggctgagactagggtgaggcacttagggtgccagcccttcacttgcatgattccttacattttgcacactgggtgccttgctgcttcaccctagtgacagctcagcccattctagaggcatttaaagaatatttggtgtctgttacacctctagctggcatcacttctgctctgtacatcttccctggttgtacttccaaagctggaaggtggagatgtagataaatagttggattagtacggggtgctcctcctgttagtgacgacaggtcaaattgatgagagatctgattttatgcatcctttttaggaatgattcttactttaaaggaaaccgggcttccaaagtgtgtactttctggacctccacaactggtgagtctttcctgacacatctttcaaaagcaatctttccttttgtaatatcagtaacaagaattttcctttttgcaaatcagtcttctgccctccagagatacctggtcgttgaaacgcttcccctttcaagttaaaaagacttgagttctgattaactatgtgaccttgatcaagttactttacctttctgagctttagtttattcatctataagatgactatcacgtttcatagagttgttaaagattaaatgacgtagcagcacatataaagcactaaatcactttattagatatatgtttggcaccaagtaggcacacaagaaagggcagcttttgtttttattcaataaatttctgacatcttcttacctttcagtccagcttattacactcttgagaaggcgtgtgtgtgttgttgaatataacagttcattttccagtccttaagaagaaagtcaccaagacctgttaagtctttccccaaaataacgtttg

SEQ ID NO: 317 - DNA, 1058 bp, Homo sapiens
cgctgaactgcagctgcatgggctgactcttatgtccctctaactccctggccacttcaggactttcgcccttccgcgggttccctctgcctcttctaattgctgcctatattgttactgaaccttcagggctcagctagagggtcatttactccagaactgcctcttcttctctagacaagttggatcccagccttctgtatttttcattttccttgcagagcacttagcataatgccactaagctgtttctgttatcgtgtttccttttgtctcctccactggcctgattagagcaaggcctccatctctttttcctgctatatccttggcatctgatataatggatactcagtaaatatttgtaataaatgatgttcaaaatatttactaagctttgttttatgttgatacctattggtaaccttttaaatacttgaatagttgctgtgttctacatttgttcaaccataactgctcatttctttgtttttcattaggaaaaatacctcgaagcaatcaaaatattttctggtccattgaaaggaatagaactgggtacgtctttgtctgtgactcatcctctgctatttctaacttatatatgccctgacctctcaaattagaatccattaaaaacatcaacatcaaacctcaaaatcaaatgcttcatcaccacgagatttttttttttttttttttttttggatagagtcttgctttcttaccaggctggagtgcagtggcatgatctcggctcactgcaacctccacctcctgggttcaagccattctcccacctcagcctcctgagtagctaggactacaggcgcatgccatcacgctcagctaattttttgtatttttagtagagacggggtttcaccatgttggccaggatagtctcgatctcttgaccttgtgatctgcccgcctcagcctcccaaaatgagctaccatgtggctggagatgggatttctaaatagtgacattttctgtgttcccacctcatgctgtaaaaataggggccaggtcggcaggagtgattgaacagctg

SEQ ID NO: 318 - DNA, 1069 bp, Homo sapiens
ctccagctgcgcaggggggcttacagcctcttgatgggaagaggcctcactgaggatgctagtagggctcttgtcctggcactggtgtgtatctgtggcttgttaatactcctcttttatagaaacactaatactttgtttcaaaatatacatcagctcttctggtttgcgatgataggttccctggcttcactattctgtttgttaacttgggtctctgaaagttgagtactagtttcttgtttttcaatttttaacggatagtcaccaaagattataatgtcttttcatctggctgtagtaaatataaatggctgaccaaaatacacttttatttatttcctaaaaatggtaatctccttagaaagtctggttttcgtgtcagattcccaccataattctgaggcaattcagttgctcgtggttggtgatcctgaagttactcttcccacacatcttcactaatgcaatcactttgctgttgtgtggttttcttgtagctgtgcggccccactctgccccagaatacgaggatgaaaccatgacagtttaccagatccccatacacagtgagtatgaaagccaggtttcccaggaggagggtgtacgtcctgagtaaagaaaacatggatgaaaatagaaactgaacacttgctgtgggcaccctgttttgtgttctgagcatgattagaaaatttagttgaggaatgaagatatggctcctgccctggcttataaacttacggatgtctgacttatgcctaatgatagtgattatgctttggaatattagataatcaagcactgttggtaaatagattgcattcaagtttgcacattcattgcttggaggttttttcccacaggcgtaataccctcttttgatcagacgatcatgaagaggtttgcacagatagatttttttaaataaataatgattacagcaacctaaaagaagtgttgttgggggttagaagctcctgcaaattccgaagtatcagggccagatgatgtggtcttagcttaggaaaagagttagtcttgtccttgaacttggctaaagacattc

SEQ ID NO: 319 - DNA, 1120 bp, Homo sapiens
gatcgatgttaacatgctcagttttgccgatcactgttttttcagtgtccagcggccctcagtgagtgaacttacgttcattctcgttgcagctgtgctttagcttcttagagcagcgaatttttttcccttgatcttgagccttaactaaatgtaaaatgaggctccttcttgagataggtaccctttgggtctatgtgttttagcgggagtgatgataataaataagcatgtctacaacccacatgctgtttagataacacgttgttgagttggtactgtggccgaggctgtgagctaagcagaaacataaacattaataggacataggtgcagcccagaaaccaggtaggaagttaactaactagttatttcctactgtatagtaaaaggtgtgctgatttaattggcgttctggcattcccatgtatgaacgtctgggccttggctgtcagctcaccttgtgcagtgtgtaatttggtggtatctgtactgaccaggtgaacagaggaggggaaagcaccaaccatggcagagtccagaaaggcctctcagcaggctcagtccagagcgatcttcagactccgagtcgaatgaaaatgagccacaccttccacatggtaatagtataaacaaaacagagcagcagaaaggcttgcgttttcttaattctctgccttgtaatgcttgtagagagtcattattgtaagaaagccaggtgtgtaaacagatccttcttcctgggcttactataacttggcccgttgggggaatgagaagggttgttgtaaaggtggcagcctgcaactttaataatgaccagtccacagttttggccacccagggtctgggtaggcccaaaactgtgttctgttttcccagaggagaacagggcctgacaaacggattcattttgtatttttcattaatgtaacatttatgcaaattttccattaatgtggaaactataactgctaagccaatgagacagtcaaatcagtgagaggctctgcacgtcttccagaatgacagcccactgggaaacggagttaaaagtccaagatgagatgtagctcaggagtcaggccgcttcgggagtttgttgtccttaacagaaggt

SEQ ID NO: 320 - DNA, 1059 bp, Homo sapiens
acagaaggtcagcgttggcaaagctcggcagctcctctttctgtcctgaggtcttgtctagtgactgagaacaggctgacccctatgtgctgtccttgtttggatggcaccgggtaaagactgacaccagcattttctctgcaggcctttgaacttttgtgttatttcatatattatatgtgttataaagcacattacaatatatttttctctgtcttctccagtcctaggtgaaatgtgtcatttaaaaaaaatttcacttgccattctaaagtttttctggtgagagttttgtgtttttcatttacgcaaacacatctccacataagtagggaaaaaaagtcttcttgagtatattagtgtcttcagcctttgtattgggacagtagcgtccattaatttttatgtgaagtgaaattaggtatcgggtcataatcagtctgtgatgtcttcacagctttcacatttaccttgtgataatcaagtgtgtttttcctcaggtgttagccagagaagaggggtcagggactcttccctggtcgtagctttcatctgtaaggtaaggaagactttccggagggctgtacatgactggggtcttggtcagcgacctctggtttgcactttttcattaatttgagggtaggcactcctgttacctgagacaagaagagatagcagatcttcagaaaagctgatggaaggccgggtgcagtggctcacgcctgtaatcccagcactttgggagtccaaggcaggtggatcacgaggtcaggagtttgagaacagcctgaccaacgtggtgaaaccctgtctgtactaaaaatacaaaaattagctgggtgtggtggcgcatgcctgtaatcccagctacttgagaggccaaggcaagagaatcgcttgaacacaggaggcggaggttgcagtgagttgagattgcaccattgcactccagcctgggtgacagagcaagactctctcaaagaaaaaaaaaattcgatagaaatgacactggcaatgagcctgcaacaagtattactactgacctttcataattgt

SEQ ID NO: 321 - DNA, 1059 bp, Homo sapiens
atttgacaataaatgacttcttcagaatatggtataccttctgaaagcaataaacgcattttaatgaattgtaaggaaacaacatcattttattttttatttttttttttgagacagactttcgcttttgttgcctaggctggagtgcaatggcgcgatctcggctcactgcaacatccgcctctgggttcaagcgattctcctgcctcagcttcctgagttgctgggattacaggcacgtgccaccacgcctggccaattttgtatttttagtagagacggggtttctccacgttggtcaggctggtctcaaactcctgacctcaggtgatctgcccgcctcagcctccgaaagtactggaattacaggcgtgagccaccgtgcctggccaacattattatttttttttaatctagaaaaatacacttctaagaaaattgattaaaaccaaccttcttcattagcccctaagatcacatctatgttctctttgttgcagcttcacttaaagagaggaaacttcttggtgctcaaagcaaaggagatgggcctcccagtgtgagtgtggggggtaaggcttctggggactcactgggtacacctgtccacttaaggaaatcacatttcacagaggccttgcctcttcatttcagtgggacagctgccatcgctcccatcattgctgctgtcaaggacgggaaaagcatcactcatgaaggaagagaggtgagatgcctggttttcttgattcagcagttacaggtagggtctgaaatgctgggcagagtctgtcttcttcaggccctacagacaccacttttgaaggacgtggaacagtttggacatcactcagctaagtgataaaatggcctcttttatctgtgtttgtcccgcatgtcaacacggctgcattcgagcatttttgtagattgtccatttaggatctagtcaccgtcctccttaaagggtgcatgctttccttggtacttgagctcaggacagtgtctaacaacagaccccatatggatgggcctggggtttatggtccagaggaatgc

SEQ ID NO: 322 - DNA, 1073 bp, Homo sapiens
gcgatctcggctcactgcaacatccgcctctgggttcaagcgattctcctgcctcagcttcctgagttgctgggattacaggcacgtgccaccacgcctggccaattttgtatttttagtagagacggggtttctccacgttggtcaggctggtctcaaactcctgacctcaggtgatctgcccgcctcagcctccgaaagtactggaattacaggcgtgagccaccgtgcctggccaacattattatttttttttaatctagaaaaatacacttctaagaaaattgattaaaaccaaccttcttcattagcccctaagatcacatctatgttctctttgttgcagcttcacttaaagagaggaaacttcttggtgctcaaagcaaaggagatgggcctcccagtgtgagtgtggggggtaaggcttctggggactcactgggtacacctgtccacttaaggaaatcacatttcacagaggccttgcctcttcatttcagtgggacagctgccatcgctcccatcattgctgctgtcaaggacgggaaaagcatcactcatgaaggaagagaggtgagatgcctggttttcttgattcagcagttacaggtagggtctgaaatgctgggcagagtctgtcttcttcaggccctacagacaccacttttgaaggacgtggaacagtttggacatcactcagctaagtgataaaatggcctcttttatctgtgtttgtcccgcatgtcaacacggctgcattcgagcatttttgtagattgtccatttaggatctagtcaccgtcctccttaaagggtgcatgctttccttggtacttgagctcaggacagtgtctaacaacagaccccatatggatgggcctggggtttatggtccagaggaatgccacagtattctatgtcaagatatttcctctgacttctgaggacattaggaccagtggccacagactgaagaaaaccttaatgccaagcctcctttcctggccagtgtaggcctgaagtgcctcaacctgacagttacctgtttaggtatccacaaagagaccagaagg

SEQ ID NO: 323 - DNA, 1113 bp, Homo sapiens
atctgtgtttgtcccgcatgtcaacacggctgcattcgagcatttttgtagattgtccatttaggatctagtcaccgtcctccttaaagggtgcatgctttccttggtacttgagctcaggacagtgtctaacaacagaccccatatggatgggcctggggtttatggtccagaggaatgccacagtattctatgtcaagatatttcctctgacttctgaggacattaggaccagtggccacagactgaagaaaaccttaatgccaagcctcctttcctggccagtgtaggcctgaagtgcctcaacctgacagttacctgtttaggtatccacaaagagaccagaagggtgttgatggtgatgtgtaaagttggttttgtgctttgtttacctctcagctcactggataggatatgtcatgttagcagttgccttgaaggcagttcagtttggtggctgagctgtgacccccagtgggcgggcttatttggttttgcagattttggctgaagagctgtgtactcctccagatcctggtgctgcttttgtggtggtagaatgtccagatgaaagcttcattcaacccatctgtgagaatgccacctttcagaggtaatgaggggtctctagggtgggagaagtgagagctgaaacccagcccagcatcgacatgggcatcttgtggcaagagctgtgtttctgggaagaccactatctgggtttacagttcagaggccggcactcctgccttaagtcactgttggtagttggtgggctccggtgtacacagcctcaaagtgaaattagaaaagattgaaaactagaaacaactgaggactagaaattcaactagaactcttacagctcttataccagaagaaattctagaacttttttgaattctaactaatgccccagattatcatttggattattttgaactgaattaattttcttccattacctgcattgaaacaaatgaggtgggtcagagtgtgtgagactgtcgtggtcaagagtccgtgttatgggatggactcacagctggggaatgtcttttgggctaactgccactctgttgttgtcctctatcgaagttaaccagttttgcg

SEQ ID NO: 324 - DNA, 1096 bp, Homo sapiens
ttagtaagtggtctgttgtccaggtggtgaaatttcagatgattttcatttctcgtgcctgtgtctcaggtcctctggaaggcagacaccagggtggcattggaggtgcaggaggtttattcgaggaaatttgactgtgagagaggaaggagagagggagcaggaggaggcagggagagcctgggtctggctttgcaggttggacccgtatgagtggagagggtaggaaggaagtgcagtgctgagaaaggatcagccaggcctactggaaagcccagagcagagcttgccagatacaggaatcccacgtccattggaaatggcccagcaccggggtctgccgtgagcagcctgctgtgagagcatggcctgggcgtggaggctgtcagctcactgcagtgctgcagagggccgcacgatacccctccctggctgcgtggtccctgtcttggtgtgtcctgagtctgcatcactttgtaaagccccactcttctgcccaggtaccaaggaaaggcagatgcccccgtggccttggtggttcacatggccccagcatctgtgcttgtggacagcaggtaccagcagtggatggagaggtatggagcccagcccagcggcacttggggtaactcttctgggcagtggtggattcccctttcctcccctcgtgctctttccagcgctacctacccttctgcacctgcctaaactttctgtgggattcctgccttcccagaattctaggcttcccagatctgtgctacactcgtgaagaaaatgcaccgctaggtggcgcagtgtccacacgattccatttattttacaccctccacactcttcagggtgtctgaacaaatactgccgtttggttgaggattccataagtgaattccaaagaagagattgcagctataaaatgatagcttccatttactgaatgcccactttgtgggaggcagtgtgtgaaatacccttcatttcacttcatttcctctagggtcgtcgccagcagccctgggaggtagatgtttagtcactggaaggcatctttttcctcggggcatcgctggccagggccaggtggaggagtatgagt

SEQ ID NO: 325 - DNA, 1139 bp, Homo sapiens
agggtcgtcgccagcagccctgggaggtagatgtttagtcactggaaggcatctttttcctcggggcatcgctggccagggccaggtggaggagtatgagttgagctcgggtgcggggtgaccttgggctgctttttggcccctgcccgtatctccccacatggcccgtttacctgcccctcactccatggcctgctctcctgctgtctctttcattcctcagggtttgggtcccctatttgtatgccctggacatcttctttttcttgtttttcctctcactcttcccagcacacctgaaaggcagctgagctagggaacaccgggctttgagacagcaggagtgggaccatgtttggccatgtagtaacactgcttggggcaagtcactgaactgtttgaacacctcatcctcattaccactcctgagctcagcaccactcctcagggggagctgcctcctaacagacgctgcaaatgccgggtctgtttcttcacaggtttgggcctgacacccagcacttggtcctgaatgagaactgtgcctcagttcacaaccttcgcagccacaagattcaaacccagctcaacctcatccacccggacatcttccccctgctcaccagtttccgctgtaaggtagtgtctcagaccggccccttgtcggcccagctctcgtcccctctctttctctccatgaatgtgttttgtctctttcagaaggagggccccaccctcagtgtgcccatggttcagggtgaatgcctcctcaagtaccagctccgtcccaggagggagtggcagaggtctgtgccatcttgaactaatggaatcgtctcagtcgagttgggaaacatttctgtaaatagccacatagtaaatgttccaggaggctctccagaccatatggtctctgttgtaactattcaactccgctttgagcacaaaagaaacacggacaataagctaatgaatgggcttggctgtgtgccagcgtgaatttatttagaaaagcagcctactccaggctgggttgaggtgggcggattggggccagtagttctccttttccaaaattgccttgcatgggaatagcagtgatagagctcgtgtgtttcacagtatagaaaataggaaat

SEQ ID NO: 326 - DNA, 1086 bp, Homo sapiens
cagggtttgggtcccctatttgtatgccctggacatcttctttttcttgtttttcctctcactcttcccagcacacctgaaaggcagctgagctagggaacaccgggctttgagacagcaggagtgggaccatgtttggccatgtagtaacactgcttggggcaagtcactgaactgtttgaacacctcatcctcattaccactcctgagctcagcaccactcctcagggggagctgcctcctaacagacgctgcaaatgccgggtctgtttcttcacaggtttgggcctgacacccagcacttggtcctgaatgagaactgtgcctcagttcacaaccttcgcagccacaagattcaaacccagctcaacctcatccacccggacatcttccccctgctcaccagtttccgctgtaaggtagtgtctcagaccggccccttgtcggcccagctctcgtcccctctctttctctccatgaatgtgttttgtctctttcagaaggagggccccaccctcagtgtgcccatggttcagggtgaatgcctcctcaagtaccagctccgtcccaggagggagtggcagaggtctgtgccatcttgaactaatggaatcgtctcagtcgagttgggaaacatttctgtaaatagccacatagtaaatgttccaggaggctctccagaccatatggtctctgttgtaactattcaactccgctttgagcacaaaagaaacacggacaataagctaatgaatgggcttggctgtgtgccagcgtgaatttatttagaaaagcagcctactccaggctgggttgaggtgggcggattggggccagtagttctccttttccaaaattgccttgcatgggaatagcagtgatagagctcgtgtgtttcacagtatagaaaataggaaatgtgtgatgaacaaagtcacccataatcctgttgcccagagataatgattgataacattttgtgtttcttgatttgtgtatgtgggtttatattgtcagtcttttcctgtatcactaaacagtcttaagtaacaagatttttattggtattccaaatagggatgttta

SEQ ID NO: 327 - DNA, 1119 bp, Homo sapiens
gaaagtgggatctcaggcctcactgcagagctgccgaactggcttctgcgttttgccaaggttcctgggtgtgaacatgagtttcagagtcactcctctagggcccctgcttctcagctcggaccattgacccctcagaggacatttggcaacatctggaaacgttcttggttgtcacagcctaggaggtgggtagtggtgctgctagtgggtagaggtcaggggtactgcaccaggacagcagcactggccacagaaaaaaactgtcttgccctgagcatcagtagttccccgttgactggccctgaggcagagcgatgcagcatccaaaaggcggtggagcagacctgccccagatcctagtcacttaaccttcagtgttgatctgaaggaacttcctgcagattgtccccctgaatttattctggacatccccaatggggtctgctgaggccatataccctgtccgtcacctgagatgcttctctctcttcctgcagggatgccattattacttgcaatcctgaggaattcatagttgaggcgctgcagcttcccaacttccagcagagcgtgcaggagtacaggaggagtgcgcaggacggcccagccccagcaggtgagtgggagcccacagagcagcctttctttcctgggctctgcccctgctgctgttttcctagcattaagtggagtgctggtggggcgcattctaacctggcttttcagtctaatccagggcttctctactcagctctacattagaattatagtcattggaggagggggctttggggagtttaagaatcccaattcctggctgggcgcggtggctcacacctgtaatcccagcacttcgggaggccgaggcaggtggatcgcgaggtcgggagatcgagaccatcctggctaacatgatgaaaccccgtctctactaaaaatacaaaaattagctgggcgtggcggcgggcgcctgtagtcccagctactcgggagactgaggcaggagaatggcgagaacccgggaggcggagcttgcagtgagccaaggtcgtgccactgcgctccagcctggacgacagagtgagactccgtctcaaaaaaaaaaatcccaattcc

SEQ ID NO: 328 - DNA, 1097 bp, Homo sapiens
tgttttgttattataaaagaatatgtgagactgggtaatttatcaagaaaagaggtgtatttagttcacggttctgcgggctgagaattgaaggtcacggccctagcttccagtgaaggcttccatgctgcatcataacgtggcagaggagcgcaagtaggaagtggacgcttgtgaagacgggataacctgagctgcactctggctttataacaacccccctctcctgggaacaaatccattcccttgagaagtaatgcagtctcctgagagccagtacttactactgcagctccaagccactcaggagggtccgtccctgtagcccaaacgccttccactaggccccgcctcccaaaaccgccatactagggagcacgtttccacatgaggtctggggacaaaccaatgacactcaaaccattgcaccttctcatggctgcatgctggctcacttttgacccaaaggaatggattgtttcacatggattttttcacagagaaaagaagtcagtacccagaaatcatcttccttggaacagggtctgccatcccgatgaagattcgaaatgtcagtgccacacttgtcaacataaggtatgctgctttcccaggaagcatccttccatcaagggcacgtttactttttaaacaaaagtcctgctgtactcaccagtcgatttgaaatgcggtatcaagccctgtcacttgtcatgtcgactggagtgtccaggagaggagcgtggccttactgcattttatagcctcagtagcaaactttaccctgggaatcaccaaaattcatcccatgatgtcttttaataaacagctgattttactgtgggcagtacacctagctaagaaattagctcctttaatttttacattaatcctatgaagtggtgaataactacccattttgttgatgagtgacctgatattcagagaggtgacttgctatggttcctacagctggtaagtggggcatctgaagtttgagcggggacttggggtcttgattgctacatggtattgtcccccagccatttgttggtagtatgttaaaaagctttagggttttgcacatttgtgttcag

SEQ ID NO: 329 - DNA, 1139 bp, Homo sapiens
tgaatgaagcacctgcagcccgccctgcaccaggtgtctttgaggacatgagctgaggaaaccccgaccacttgcaaagggggaaaagtccgatggcagctggacctagaaagagtctcatatggcccagtgcctgtcctggtattttcaacagaggctgtggccacagtcaatctgcatggtcagattcattgttaggactaaatgctttaagcctcctataaactttttttttttttttttgatgcccagcctttgtgtaagtctacttgaaagggtttcagggttccatggatacttctttgctataaagaggatgacacatgtaaaatcacctttatggttaaattaattggcttttatattagctcctcaaagcaaagcaggagagacagaaatttctgcagttgcttcttggtcctgtccaaagcagacatcagcctctgaaccatcagcagtcttcctagtggcagtgactctcttcctcttctcttctgcagccccgacacgtctctgctactggactgtggtgagggcacatttgggcagctgtgccgtcattacggagaccaggtggacagggtcctgggcaccctggctgctgtgtttgtgtcccacctgcacgcagatcaccacacggtgagtgttgggctggaccacaaagctggagcctggaggaggcactgccacgttgagttggccctttggctgcgtcttttcctccgcttccaaacttgcccagagcttttgttactcatctctggctaggaaatggttttttgcaaaactcaacatagtccttctgcgccacaagaatgtcttctcttcctgttcagttcctttcctgcagcaggacaggtttgagtttacccagccttccttgagtcttgaatctcacacggcctgctcagcggaagctttgaccggatgcaggaggtgtggctatgagaccctcaccttggtctcctggggtgccgggccctgggccgttgccctcttcccagcacgggtcgtgtcgctttctgcctgtgacatttcagggccatggcgcagggggctcggcctgtgccacccccactgcggctgtgttagaggctggtgggtgacgtcgggctggcaactcctgcaagagagagggc

SEQ ID NO: 330 - DNA, 1039 bp, Homo sapiens
gctgcgtcttttcctccgcttccaaacttgcccagagcttttgttactcatctctggctaggaaatggttttttgcaaaactcaacatagtccttctgcgccacaagaatgtcttctcttcctgttcagttcctttcctgcagcaggacaggtttgagtttacccagccttccttgagtcttgaatctcacacggcctgctcagcggaagctttgaccggatgcaggaggtgtggctatgagaccctcaccttggtctcctggggtgccgggccctgggccgttgccctcttcccagcacgggtcgtgtcgctttctgcctgtgacatttcagggccatggcgcagggggctcggcctgtgccacccccactgcggctgtgttagaggctggtgggtgacgtcgggctggcaactcctgcaagagagagggctgcagaccctaacccggaggggatggccctggggcctggctgacgcatgtctcctgtttccttgccagggcttgccaagtatcttgctgcagagagaacgcgccttggtaagtgtggcacttgatgggcgttctgagtttcagcggtttacacatcatccgccatgcctcttggcactccagtttttattgagatgttctgtcgtcgagtcggcacttgcattttttgttccaggcatctttgggaaagccgcttcaccctttgctggtggttgcccccaaccagctcaaagcctggctccagcagtaccacaaccagtgccaggaggtcctgcaccacatcaggtgagcatccagggcagcctggcccgctgggctgttgcttgctgccgtctccttcagaagctcaaggtggacactggggtagttaccaatatcccccagcagccttgcccttgacatggtcccagatggcagaagcaggggagaagtgcattggctgaaggacagaaaccattagatagttcccatgtaatgcttattttcttagaagcatttcttcccagtcctcatttgagttctgagctgctttctaaacttcgagcagc

SEQ ID NO: 331 - DNA, 1110 bp, Homo sapiens
gccttccttgagtcttgaatctcacacggcctgctcagcggaagctttgaccggatgcaggaggtgtggctatgagaccctcaccttggtctcctggggtgccgggccctgggccgttgccctcttcccagcacgggtcgtgtcgctttctgcctgtgacatttcagggccatggcgcagggggctcggcctgtgccacccccactgcggctgtgttagaggctggtgggtgacgtcgggctggcaactcctgcaagagagagggctgcagaccctaacccggaggggatggccctggggcctggctgacgcatgtctcctgtttccttgccagggcttgccaagtatcttgctgcagagagaacgcgccttggtaagtgtggcacttgatgggcgttctgagtttcagcggtttacacatcatccgccatgcctcttggcactccagtttttattgagatgttctgtcgtcgagtcggcacttgcattttttgttccaggcatctttgggaaagccgcttcaccctttgctggtggttgcccccaaccagctcaaagcctggctccagcagtaccacaaccagtgccaggaggtcctgcaccacatcaggtgagcatccagggcagcctggcccgctgggctgttgcttgctgccgtctccttcagaagctcaaggtggacactggggtagttaccaatatcccccagcagccttgcccttgacatggtcccagatggcagaagcaggggagaagtgcattggctgaaggacagaaaccattagatagttcccatgtaatgcttattttcttagaagcatttcttcccagtcctcatttgagttctgagctgctttctaaacttcgagcagcttttcttgatgagacagttccagagccaagcacccaaatagtggctagcacagagaatgtccatagcaggtgtgtggctagctggcaggtggcaccatcctcaccccaaggggaaggagtcccctctgctggagccatccgtggcccgtgctgcctgagccggaggcagcattcacctgctgggtttctcccagtggcctagaggctttggtttggctctttatatttgactgctgt

SEQ ID NO: 332 - DNA, 1100 bp, Homo sapiens
gagaagtgcattggctgaaggacagaaaccattagatagttcccatgtaatgcttattttcttagaagcatttcttcccagtcctcatttgagttctgagctgctttctaaacttcgagcagcttttcttgatgagacagttccagagccaagcacccaaatagtggctagcacagagaatgtccatagcaggtgtgtggctagctggcaggtggcaccatcctcaccccaaggggaaggagtcccctctgctggagccatccgtggcccgtgctgcctgagccggaggcagcattcacctgctgggtttctcccagtggcctagaggctttggtttggctctttatatttgactgctgtttcctcatcatagtgactatgatttaactcatgttttctcctaagaatgattttggggttctccagccaaagacttaaactttggttccagatgtccaagaaacgtttattatcattttaaatgttttgtctttttacagtatgattcctgccaaatgccttcaggaaggggctgagatctccagtcctgcagtggaaagattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatgggtgagtagaggaagaagcaagccaccctgaggttgctctggggtttgtgtagctggaggtgaatgcaggtgggcttgcagggaaacgtcagcagaggcaggagactcaggtccccaccctcagagtctctggttgtcatcctagtaggcagacccagggccaggggagctgagtgttgagaccaggaaacagcacgtgactgaggcctgtgtgccgctctcgcagagaactctgccctgatccttgtgctgcttctccagggaaagatgccaccctcctgatacatgaagccaccctggaa

SEQ ID NO: 333 - DNA, 1121 bp, Homo sapiens
aatgtccatagcaggtgtgtggctagctggcaggtggcaccatcctcaccccaaggggaaggagtcccctctgctggagccatccgtggcccgtgctgcctgagccggaggcagcattcacctgctgggtttctcccagtggcctagaggctttggtttggctctttatatttgactgctgtttcctcatcatagtgactatgatttaactcatgttttctcctaagaatgattttggggttctccagccaaagacttaaactttggttccagatgtccaagaaacgtttattatcattttaaatgttttgtctttttacagtatgattcctgccaaatgccttcaggaaggggctgagatctccagtcctgcagtggaaagattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatgggtgagtagaggaagaagcaagccaccctgaggttgctctggggtttgtgtagctggaggtgaatgcaggtgggcttgcagggaaacgtcagcagaggcaggagactcaggtccccaccctcagagtctctggttgtcatcctagtaggcagacccagggccaggggagctgagtgttgagaccaggaaacagcacgtgactgaggcctgtgtgccgctctcgcagagaactctgccctgatccttgtgctgcttctccagggaaagatgccaccctcctgatacatgaagccaccctggaagatggtttggaagaggaagcagtggaaaagacacacaggtagcaaaggccggtcagtccttgtcgcccacatcctctccctcccccactacgtgacactgagcagccgtcgtttgtctccactgatgtggggctgccctgcttcctatcaagggctatgggggcttccttgacctgtggcagtgctcacaggctcttgg

SEQ ID NO: 334 - DNA, 1079 bp, Homo sapiens
gattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatgggtgagtagaggaagaagcaagccaccctgaggttgctctggggtttgtgtagctggaggtgaatgcaggtgggcttgcagggaaacgtcagcagaggcaggagactcaggtccccaccctcagagtctctggttgtcatcctagtaggcagacccagggccaggggagctgagtgttgagaccaggaaacagcacgtgactgaggcctgtgtgccgctctcgcagagaactctgccctgatccttgtgctgcttctccagggaaagatgccaccctcctgatacatgaagccaccctggaagatggtttggaagaggaagcagtggaaaagacacacaggtagcaaaggccggtcagtccttgtcgcccacatcctctccctcccccactacgtgacactgagcagccgtcgtttgtctccactgatgtggggctgccctgcttcctatcaagggctatgggggcttccttgacctgtggcagtgctcacaggctcttggcctttatttttgcagaattttctaagcaagattctagagtgaggcacagttttttgaaagcatctagaaatcggctgaataaactataagccatgtcagggaattgccaggggaaggcgggggctgggggactgaatttttggctgctaatttcaacgaaagagtgcattaccccaggtgggccctgtggtttctcttgggtgccctcatggacagatttggcagccagcacagagggtgggcttcatccaggggtgtgtgcgaaggctctggccctcaggggagattgtgctggctacggaggtgcccgttaagaaaacccaccagcttccccgggtg

SEQ ID NO: 335 - DNA, 1145 bp, Homo sapiens
gctgccctgcttcctatcaagggctatgggggcttccttgacctgtggcagtgctcacaggctcttggcctttatttttgcagaattttctaagcaagattctagagtgaggcacagttttttgaaagcatctagaaatcggctgaataaactataagccatgtcagggaattgccaggggaaggcgggggctgggggactgaatttttggctgctaatttcaacgaaagagtgcattaccccaggtgggccctgtggtttctcttgggtgccctcatggacagatttggcagccagcacagagggtgggcttcatccaggggtgtgtgcgaaggctctggccctcaggggagattgtgctggctacggaggtgcccgttaagaaaacccaccagcttccccgggtgccctggcagttgatggccagggtctgtgccactgtctgctttgcagtcttgcagttgagttcagcttcagtctgctctgtccttcacctgcagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgtatgtcacacggacagcacagggcggggacggggcagggagacaggactctacacactgagtaggacggtcagctggagtttgctttcttatttggggccaccgtgggaaaaggttatctacccatcactaaccaggtcgaaccaccctgggtttgctggtgagacccacctcctgcaggggccaactagtcttcagtctcagttcactggaaatttctgagaatccttttaggcctggactgctcacacagtcatggcatttgagcctcagcacagacctgtgagacaggtggttgcctcttgtgagtgggaaagccaggcctgacccttggccttccggaatgaaggggcagagccggagccaggcctcgtttttcaggagcttgattttgagagcatctggactgctctcccttccctctccggaggcccttagccaggcctggggagcctctgcccctttagagggttccctccatgccattcttttttcc

SEQ ID NO: 336 - DNA, 2434 bp, Homo sapiens
gtcgaaccaccctgggtttgctggtgagacccacctcctgcaggggccaactagtcttcagtctcagttcactggaaatttctgagaatccttttaggcctggactgctcacacagtcatggcatttgagcctcagcacagacctgtgagacaggtggttgcctcttgtgagtgggaaagccaggcctgacccttggccttccggaatgaaggggcagagccggagccaggcctcgtttttcaggagcttgattttgagagcatctggactgctctcccttccctctccggaggcccttagccaggcctggggagcctctgcccctttagagggttccctccatgccattcttttttccatttcagctgtggcctgttggcttgtgccaaggaaggggcgttggcgctgctgtgtgagcacatgactgcatcccttccagctcctgtcccccacccctgcccctctgagacatgtccttgtcttctattgtgtcttctaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttacttttgacaacgatttgtacatgtatttaaagataacaactttcaacccccacccttaccccagactcccattacaaattgaggcatgacctgcccttgccaggaagtgagcaaagctgcaacatcaaaactctgcacatcccactctcagaggagggtgactttacactgtgttgggaaaaataactaagcatttaaatttttcattgtacacctgtacattggtttagattgaatggctcaaattaaacaaatatagagagatttcatatatacaaatattatatcatgtataggtatattatatcatctatttgaaaaggataaaattttaaactttgactttgcatgcatggcccaaatcttttctcactcccctaatccccaagtgtgaaaaggctacccggtgccctcccggccctcgtccccatgaccagatgggacttcatgagaaggaaatgagcggctgacgctggtgagcaaagcaggccacaccgcag

SEQ ID NO: 337 - DNA, 1500 bp, Homo sapiens
ctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttacttttgacaacgatttgtacatgtatttaaagataacaactttcaacccccacccttaccccagactcccattacaaattgaggcatgacctgcccttgccaggaagtgagcaaagctgcaacatcaaaactctgcacatcccactctcagaggagggtgactttacactgtgttgggaaaaataactaagcatttaaatttttcattgtacacctgtacattggtttagattgaatggctcaaattaaacaaatatagagagatttcatatatacaaatattatatcatgtataggtatattatatcatctatttgaaaaggataaaattttaaactttgactttgcatgcatggcccaaatcttttctcactcccctaatccccaagtgtgaaaaggctacccggtgccctcccggccctcgtccccatgaccagatgggacttcatgagaaggaaatgagcggctgacgctggtgagcaaagcaggccacaccgcaggccgagcccgtgggccagcgtctccgtggctggtttcacttttcctccacatgctttgggtaacgtaattattgctattcagtttgaacctccagaaagaagagacaggctccaggaccccacagactagtgaactgggtgcctttaggtacgtagaggggtaaaattactctcatatagccaatatatttggggacagggaggccacctttggctcctccagacactgtcaggcttgtttgttttgttttatagattcagaaatataaaatgatataggagctttcagtcacacagtggaaaaaggaaaactgttaggaagtgaaacatttttgttttcagccatttactttggagcccactgatgggggcggcctgaaaggttttccagtggcaagccctcccccaggtagctggcaaaggtcagtgccccaggactgctagaatcctggacctggtccagttgtgggtgagaggggccctgctgtcctgcttccttt

SEQ ID NO: 338 - DNA, 1731 bp, Homo sapiens
aactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaaaaaaaaaaaaaaa

SEQ ID NO: 339 - DNA, 1500 bp, Homo sapiens
atattacagctaacaaaaaataacatttaaaaacactaaatagtatatatatgaagtatttataattattttaatattgtaataatatagtgtgttgtgatttgaattcatctgcacggaaatcgattactgtcctttctttctatttccctatattttctttccgaaggcgtcatcaacattttggttctttaatagtaaccaaaacccgaaatcatctcggttctcagtatttggctctatgggaacaccttttcttttctctctttttttttttttttgagacggagtcttgctcctgtcgcccaggctggagtgtaatggcacgatctctgctcactgcaacctcagcctccccagtagctgggattacaggcatgcgccaccacgcccggctaattttgtatcttttagtagagacggcgttcctccatgttggtcaggctggtctcgaacttcaaacctcaggtgatccgcccgcctcggcctcccaaagtgctaggattacaggcgtgagccaccgcgctcagcctgggaacaccttttcttacatcttcaagtgctagaaatgcttatgaaaacgaaaaaagaattattaagagtaattataaagaaacactcattttcttcccaagagagccaagatttcttctttcctcttctttcttttttttttctttctaatttcaaaggagtataattaaattgccaggtaaaagctcaaaggtcttttttatagtgttctggaaggttctctgcctgtgtttgtatttcctttagcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccct

SEQ ID NO: 340 - DNA, 1434 bp, Homo sapiens
aggattacaggcgtgagccaccgcgctcagcctgggaacaccttttcttacatcttcaagtgctagaaatgcttatgaaaacgaaaaaagaattattaagagtaattataaagaaacactcattttcttcccaagagagccaagatttcttctttcctcttctttcttttttttttctttctaatttcaaaggagtataattaaattgccaggtaaaagctcaaaggtcttttttatagtgttctggaaggttctctgcctgtgtttgtatttcctttagcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttggtagggaaatggccttgggcggaggcgggggacaggcagggaacggagtggccacgtccaggtttcctgcggccaccgaaccggtgcctcgcgccctggcgcacccacgtcctcggttcggggtggacttggggttccaaaacagccccagccggtggcggagtctttacgacagggaccagcgggctcgcccttgtccttgcagcgggccccggatgtgggcctcaggcggggacaggcgcccgcagggaggcctccagggccgctatgca

SEQ ID NO: 341 - DNA, 1108 bp, Homo sapiens
tgggaggctgaggcaggaggattgcttgaggccaggagttcaaaaccagcctgggcaacatggcgaaaccccgtatctacaaaaagttaaaaattagccaggcatggtggtgcatggctgtagtcccagctacttgggaggctgagacaggaggatcacttgagccctgtaggtccatgctgcagtaaaccaagattgtgccactgcattccagcctgggccacagagtgagaccctatctttaaaaaaaaaaaaaaaaaaaaaaaaaaaaaacaggaatgcatgcagattaaactatgtgtctgtatacagtatgcaaactttagcaagtgccaggcacttaggcagtagtctatagctgaaaaataaaacattcagaaccactttttaaggttttgtgtccttgtaactttaggcattattattacaatataacttagctgggacatgagagttaatagatccacattttaaagtagattttttttttaattttctagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctagtgagtggggctgcctatacta

SEQ ID NO: 342 - DNA, 1241 bp, Homo sapiens
cagtagtctatagctgaaaaataaaacattcagaaccactttttaaggttttgtgtccttgtaactttaggcattattattacaatataacttagctgggacatgagagttaatagatccacattttaaagtagattttttttttaattttctagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctagtgagtggggctgcctatactacttgttttcatgctgttcagattcatttaattaaatttatttttgattatgtaatatgatttcatggtttagaattcagaagatatgagtgtccagtgaaaagcttccttctcattccagtccccctcgctacccattggacctccacagaattgatgttattgattattctataaccttccagagatagttgatgaatttgttatatatctgttttattatttttacataaatgatagcatactaggtataatttttcttttatatctttacttaacattattcagtatttcattgttgcattagtagtaaatgtatgtaatttaacctatgtatttgcttattgattgtgttttaaaagtgagatatgcttgttttagggattgtttaatgaaaaggcacagaaacccactcaagctagcttaagcaaaaaaagacttcattggaagggactagaaactggaaaggatgtcaggac

SEQ ID NO: 343 - DNA, 1066 bp, Homo sapiens
cccgggttcaagcaactctcctgccttagcctcctgagtagctgggactacagctataccacacctgactaatttttgtattttagtagagatggggtttcaccatgttggccaggctggtctccaactcctgacctcaggcaatccacccacctccacctcccaaagtgttggattacagttgtgagccaccatgcccgggcctttcatgccttttcatctttttagttgaacagggcatgacactgccagctaaactttgacttaatgtgactttatgtattgtgtccagagaacagagggtcaatattagaaaaggtgttccctcctgggtgtgtcctttatgaaggatgtgtaagggaagaaattataggaatagctactgcataaattttttttctcttagtccttataattcgagaattttaggattagcttattaggaaaatagtatggaagactgagttatagtcaactgacattgtctttttactttatagctggatcatcattgaactaaaacacaaagcaagagaaaaaccttatgatagtaaaagtttgcggacgtaagtgcaattaaatgcatcatattcttgcacagttggtggctcaaatcttccatcctacaccattagaaaaagcaagtctaaatgcttttttatatttctgaaaaataaagttacttgaaatagagttgcaagaatagcacagagattctgggaatacacttcactcagattcaccaattaacattttggcacatttgctttttatatgtgtatgtgtggatgaatatgtgtgtgtgctttacatcagtgtatctatgcatgtataaatatttttcccagaagcacatgagagcaagttgtagacatcaggcccctttacccctaagtacttcagtgtatgttttcctaagaacaaaaggcattcttttatataaaccactatacaacgatcaaatttaggaaaaatttttttttttttttttagacggagtctcgctctgtcacccaggctggcgtgcagtggcgtgatctcagctcactgcaacctgcgcctgccg

SEQ ID NO: 344 - DNA, 1064 bp, Homo sapiens
catcccaaagtgctgggattacaggcatgagccacctcacccgagccttgatgttccctcttaactaaaagcaggttatgcatttttgacaggaaaactacttaagcgatcttgtgtcctttataatacttcacattaggagttgcatgatgtcagcttgtccctttactagtaaagtaaactttggttaaagtggtatccaccaggtttttccactgtgaagttaccattctccctttgtaatccataaataatctatgggcagatacttggatactaagtaaatgttctttttctaattaaactggtacccagcagtttgaatatcaatggatgattccagcctgaatcaattattattatgatagttgcaaaatggcagaaaaattttaactttaatgacagttttagaccctgagctgtctgcttaaagagtagtgcttcttactgttgtgtggtacaaacatttttttttaatacagattttaaattctttacagtgcacttcagaaggagatcacaacgcgttatcaactggatccaaaatttatcacgagtattttggtatgattttttaataagtgagctttagcagacagttggtgagacagtatgttttgagtataaggacagccagtgatttaagtggtggttaaatgcacttactggagcaacagtttcggatctgggtacttaatgtgaatttcctgttactgtttttttttgtttgtttgtttctttaagacagactattgctctcttccccaggctggagtgtcatggcaagatctcggctcaatgtaacctctgcttccaaggttcaagcaattctcatgcctcagcctcccgaggagctgggactacaggcacatgtcaccatgcccagctaatttttgtatttttagtgtcggcggggttttgctatgttggccaggctggtctcgaactcctggcctcaagtgatctgtctgcctcagcctctcaaagtgttgggattacaggtgtgagccaccacgcccggcccattgtttttggttatcgttgttttccttccatagcctttg

SEQ ID NO: 345 - DNA, 1102 bp, Homo sapiens
tcaccacgcctggctaattttgtatttttagtagagatggggtttctccatgttggtcaggctggtcttgaactccggacctcaggtgatccgcccacctcagcctcccaaagtgctgggattacaggcatgagccactgcacccggccttacctttcatttctttagtaatttagttttaaagtagttctaatccaaataaaatactttcatatcttatttaaaaatcttttcaatataagaaaatcctcttaggaaaaattgtacattgtaattatgtttggttgcatggctgtcttatttccctttgatagatttagagacctcccaaagatttcttgattagtgataaacttagttatccactaatggaaaggaacagtgatgcatgtagattatagaaaatcaaacactgaatattctgattctcaattaatgttattttcaaatgattttgattatattagtattaatttgtattattcaatttttttccccagtatgagaataatgttatcactattgatctggttcaaaattcttctcaaaaaactcagaatgatgtggacatagctgatgtggcttattattttgaaaaagatgtgagtatcatcttctttattcctgtgttcaggaatgtagtctatcatgcctcaatgaattaaatatatttcatcacctttttatccacttacagatcaaccaaatggttcgctgctgccgttaattttgtcctccctgtcactcacatgcatcttgcttgtttgtatatttatgcctcttatcaaattgttctgcctaaaatatctcccctctttcttataattcttatttattatctacttggtggttacttagtttgtgcatatatgctcccctatgatatttataatttacacaaataaaagtctgttaaaaaagactgtaactgatatgattaaaatattttgttgaaactttaatatattatagtgaggtattttctgctgaaatatgaggtttgcttcaaaataatctgggcgggggtgaaaggatgaaaggaagaaaagatgaagtaagagaggctatgtgttgttggccttgcatctgggtgataggtaca

SEQ ID NO: 346 - DNA, 1201 bp, Homo sapiens
ttcttataattcttatttattatctacttggtggttacttagtttgtgcatatatgctcccctatgatatttataatttacacaaataaaagtctgttaaaaaagactgtaactgatatgattaaaatattttgttgaaactttaatatattatagtgaggtattttctgctgaaatatgaggtttgcttcaaaataatctgggcgggggtgaaaggatgaaaggaagaaaagatgaagtaagagaggctatgtgttgttggccttgcatctgggtgataggtacatgggcatcattgcactactctttctactttcgtgtatgttgaaaggttcctgtaataaacagttttttaaagttccaataaattagattgttatcactaaaaccataaagattcttggcagcggttcttttggcatacaatttgtatgtaattatatgtggccatggttggtttccttaaatatttttaattccttttctccttttcaatacaggttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggtgagtacagaacaagtaaaatttcatttaagggtatattttttcaagaaaaagtaatagtggctgggcgcggtggctcaccacacctgttatccctacactttgggaggctgagacaggtggatcacttgagcccaggagtttgagaccacactgggcaacatggtgaaaccttatctgtagtaaaaatacaaaaattagtcagatgtgatggcttgcacctgtggtcccatctacttaggaggctgatgtgggagtggtcagttgagtccaggaggtcaaagctgcagtgagccatgatcacaccactgcactccagcctgggcaacacagcaggaccctgtctcaaaaagaagaaaaaaggaaatatgaaaaagtaacatccatattccaaaacattcagggaaaaaaatcttcatttttaaataatttttttatggtgaatgaatctattgtatctctggtctctttttacaaaagtcattttatgaagcaagaaa

SEQ ID NO: 347 - DNA, 1045 bp, Homo sapiens
cctcggccccacaaagtaccggtgagccaccacgcccagcccaccttatttatttttaagagacagggtcttactctgtagcccaggctggagagcagtgatgccatctccactcactgcaacctctgcctcctgggttcaagcaattctggtgccttagcctcctgagtagctgggactacaggtgcgtgccatgacacctggctaatttttgtatttgtagtagagatggggtttcaccgtgttggctgggctggtctgaaactcctgacctcagatgatcttcccgcttcggcctcccaaagtgccgggattacaggcatgagccactccactggtgtgaaatttttaatttaagaagcaataaatgtttatggatagatgttaaaattagttttttttcagatcaaaattatgtccattaaaagcatatatgtctgtttagataatctttttttgaatagcagtcctaaaacaatagttgtctttcttccactcaggttatttccagaaagaagagaatggcaaagtatgagaaggctgaggtaaatggattacttacctaaatagaaaggccctgttgaatctcttactcctaatcactctaccttcctacacactgatgcatttcagttatactggagtccctttatactgttgtctttagggtcttagggacagtcttagaatgtactcttacctaaatattcttgcgtgagttccatggcagatcaccatctgttttctgcctcatagaagagtggaatgggaagcctatggtttttattctacaaagagtcaacatctaacagaatcttctgaaggcatactccagtggattcaccttggagaaactcattgtgactgatgatctgatttattatctctatgccagtgaaataatcatttaatatgaacttaatttgtcataatctattgtgtactaactagtctatactagtgtgacatcaaagtgtcagattgttagtgtgtttcagtcccttggaattgaatatgaacacttatccttgaaccctatcaataa

SEQ ID NO: 348 - DNA, 1457 bp, Homo sapiens
gcaaggattaaacataatcagtgtaaagtgttggtcccatgcttgccacataagaaaatatttgtcaacagagtggtagttgtcattatcattgtctcagtttgcctgtaactagttgtgtgatctgagacaaacactaattttgaacttgagtttccccacatgtaaaatgaaagattgataatagaaagtaaatcaattttttctagcattaaaaatagtatgcatttaataaaaatcttattcttaatgatctagcttacctccaacttgccctagtcactttggcgatcttgtctctaaatagaaccttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgagatggagtcccactctgttgccaggctggagtgcagtggcacaatctcggctcactgcaacttctgcctcctaggttcaagcgattcttctgcctcagcctcccgagtagctgactacaggcgcccaccaccattcctggctaatttttgtatttttagtagagacaaagtttcaccatattggccacgctagtctcgaactcctgacctcacgatccacccacctctacctcccatagtgctggggttacaggcgtgagccaccgcgcccggcctctttttttctttttgttttgttttttctttttttttttgagacaggatcttgctctgtggcctaggctggagtgtagtggtgcgatctcagctcactgcaggattcaagcgattctcctgcctcagcctaccaagtagctaggattacaggctcccactaccatgcccgg

SEQ ID NO: 349 - DNA, 1500 bp, Homo sapiens
aaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgagatggagtcccactctgttgccaggctggagtgcagtggcacaatctcggctcactgcaacttctgcctcctaggttcaagcgattcttctgcctcagcctcccgagtagctgactacaggcgcccaccaccattcctggctaatttttgtatttttagtagagacaaagtttcaccatattggccacgctagtctcgaactcctgacctcacgatccacccacctctacctcccatagtgctggggttacaggcgtgagccaccgcgcccggcctctttttttctttttgttttgttttttctttttttttttgagacaggatcttgctctgtggcctaggctggagtgtagtggtgcgatctcagctcactgcaggattcaagcgattctcctgcctcagcctaccaagtagctaggattacaggctcccactaccatgcccggctaatttttgtatttttagtagagaaaaggtttctttttcttttttcttttctttttttctttttttttttttgggggggtgagacagagcctaactctgttgcccaggctggagtgcagtggcacaatctcagctcactgcaacttctgcctcctgggttcaagcaattctcctgcctcagcttcccaagtagctgggactacagatgtgcaccaccatgcccggattatttttgtatttgtagtagagacagagtttcgccatgttggccaggctgatctcgaactcctgacctcaagtgatccacccaccttggtctcccaaagtgctgggattacatgtgtgagccaccatgcctggtcctatttactctttgttaagtggaagtggatcatcataaaggtcttgatcctcatagttttcactttgagtaggctgaggaagaggaagggttggtcttgctgtctctgggtcgcagaggcagaagaggtggaggagg

SEQ ID NO: 350 - DNA, 5460 bp, Homo sapiens
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccggcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttcctt

SEQ ID NO: 351 - DNA, 1673 bp, Homo sapiens
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttcaaaaaaaaaaaaaaaaa

SEQ ID NO: 352 - DNA, 3008 bp, Homo sapiens
agcgcgctggcgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 353 - DNA, 2887 bp, Homo sapiens
agcgcgctggcgggaggtttggagcagatggataccgtatcgacgtggggcctccggtatgttgccgctgcgttgaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 354 - DNA, 4612 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaaaaaaaaaaaaaaaaaa

SEQ ID NO: 355 - DNA, 4554 bp, Homo sapiens
gggagccggcgctggggtcgcgcggaagggagcccccggagaggcgggagccgggtgttggcgttttggttctttttgttcattgagcgcaggcagctatgtcttcttcaaaggagaggagcaaagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaaaaaaaaaaaaaaaaaa

SEQ ID NO: 356 - DNA, 2721 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatgatggcatatgtcatggcaacctgcaggcatggtgatctccagccttgtggtcagaggcgttctcctgtccccaccgaggtggccagagacgagacgctgccagcccattctcctgcaaaacgaagacccttcttccccaaggtcatttgatctgttattgctcagctgccatatctgccccagggtcgcgtcctccaaggcgtgccctgcagaggcgggctgttctgaggggtgtgccggcagcagagcctggccacagccagggccctgtctcgctccccagcagcccggccagggcttgcttccatcttgactgtctcctttcttggatcagtcaacagatcctcacattactggctttatttacatctcttactaaagtaatcagatgatattaaccactttgcttctgaaaaagaagttggtcatttcctaaataacagagcagctaagtatgggactggataactgtctgtggcaaagacagttgttattttatgtggaatataataattacaggaagcaatgctttgattaaaggcattggcacctcccttgcaagcattgatttgctaggttcttaaaacttcaactgccagtgctctatgctgatcttagtagttaaagaggacaaggctcattttgtatagagccctgcttctcttggctttggcattttctgttgtttgaaaacacacagactaataaagatgtctgcgtattttgtttaaaggcttgcatggcataggaaagaaaaatagttttagattttaaaaagttgaaatttggtgataatttattttggatcagaaataaagctttgtgaaaaaattataacccacgtatgtatttgaggattgctgtctgattaaaaagaaagctttttatttcttcccctttaaaagatcacgttaagctaaggaaaatcctggttgatgtttttaacagtaataagatgtacggggcacatatggtttttaaagcccttttatattctgtcttatttgattctgaataagctaagttggtagatatgtgttcaattccatcacagtcaaaaggttactgacagagaatcacttttgaagtataaagaaataaattattcaataacacttaaaaaaaaaaaa

SEQ ID NO: 357 - DNA, 5204 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 358 - DNA, 5134 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttcaaaaaaaaaaaaaaaaaaaaaaaaaaaaaaaa

SEQ ID NO: 359 - DNA, 2565 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaa

SEQ ID NO: 360 - DNA, 3309 bp, Homo sapiens
tgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtactccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacgaatatatgcctttggatattaaattaatgcttgatgataaaagaatcaaacttttttttttttgagatggagtctcgctctgtcacccagactggagtgcagtggtgtgatcactgctcagtgcaacctctgcctcccaggatcaagcaattctgactcagcctcccaagtagctgggattacaggcgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagagga

SEQ ID NO: 361 - DNA, 2649 bp, Homo sapiens
aggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttataaaaaaaaaaaaaaaaaa

SEQ ID NO: 362 - DNA, 4749 bp, Homo sapiens
tcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatt

SEQ ID NO: 363 - DNA, 4569 bp, Homo sapiens
tcttgttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatt

SEQ ID NO: 364 - DNA, 1753 bp, Homo sapiens
agcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtaaattctcctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaaaaaaaaaaaaaaaaaaa

SEQ ID NO: 365 - DNA, 1738 bp, Homo sapiens
agcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaagatcaaaaaaaaaaaaaaaaaaaaaaa

SEQ ID NO: 366 - DNA, 7144 bp, Homo sapiens
gagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaattaaaaaaaaaaaaaaaaa

SEQ ID NO: 367 - DNA, 3723 bp, Homo sapiens
gagtcacgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttttggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtttcactcttgttgcccaggctggagtgcaatggcacgatcttggctcactgcaacctctgcctcctgggttcaagcaattctcctgcctcagcctccagagtagctggaactacaggtgcccgccactatgcccagctaatttttgtattttttagtagagacggggtttcaccgtgttggccgggctggtctcaaactcctgacctcaggtgatccacccacctcagcctcccaaagtgctgggattacaagcgtgagccactgtgcctggcccttttttttttttttttttttttttttaaagagatggcatcttgctatgtcgtccaggctggtcttgaactcctgagttcaagcagtcctcctgcttcaacatacagctacaggtaccccccactatacatttttaataaggattcatggctcagagggattttctgatggttttgctgatttgtttctagtttttttgtgtttatatttaacatgaagaccaagtttatataactaggtatctgtataatgcaacaacattggaacacaataaagatgtatttttgtaaaaaaaaaaaaaaaaaaaaaaaaaaaaaaaaaaaaaaa

SEQ ID NO: 368 - DNA, 1760 bp, Homo sapiens
gagtcacgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttcaaaaaaaaaaaaaaaaaaaa

SEQ ID NO: 369 - DNA, 3047 bp, Homo sapiens
tcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaaaaaaaaaaa

SEQ ID NO: 370 - DNA, 1500 bp, Homo sapiens
ttgctgtccctgagtctcatctctccctctccccgtccctccctcaagtcctgtgggtctccgtccctccgtatgtctttacttaaagggaaatccagacccttccacaggccactctagaggctccatttccccttcaggtccggaagtggagtgtcctgggttccatccagatcgcatgtcttctacgtctacgttcgtgtctcccgcctcttccctcagcctcacccgaatcagggcctccagagcattctgggcagtagcgagtccctgggtaaggggcgtccagggcacctccctggggcccggagcagctcattccaggacatctgggacaggaagggtaccgggaatgaactggggtgctagtacccaggacccaaagccaggggctgccagaaatacctattaacccccatttcccagcctcctcttacacaggcgcattcccgggttctcctctgaggccgggagcggcctcccagccccacccccgactccccttcccccccaggagatggacactttatagagagagctttttattctctcgttaaacctgtcaaagcgcaggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccac

SEQ ID NO: 371 - DNA, 1757 bp, Homo sapiens
cccttcccccccaggagatggacactttatagagagagctttttattctctcgttaaacctgtcaaagcgcaggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcaggtacctctattaccctgggtccccttgtctctgagcctggggttgtgggtcccaatggcatttccctgggaggaggaggagggagacttggagctggtgaggatgagcttggtgctcctcccttggttattaggactctgaaggaggtctgagtagctggagggcctggatggaggtcagtgtgaggggcctgagctgggtgctatctgaagcctgaaggccacctcacttctccaggaggccctgggaccagcctttcaacatgtctgagaggtttagatctctttgctgttgagtggggatcagggtgtccctacccagcacaattccaaactaattctacacaaaagctaaataactctcaattcggtgcgtggggagtgggtgtgggagatgggtaaaaaggtattggatgtactgtagagaatacaacctctcactttctattagatgagttttccaatttccaaagaaaaatttaggtttcctgcagccgtgac

SEQ ID NO: 372 - DNA, 3279 bp, Homo sapiens
gatgagttttccaatttccaaagaaaaatttaggtttcctgcagccgtgacatatgtgtgtgcactgggatgggttaatgtgtgtgtgtgtgtgtgtatgcgcatgtattgggagtgggggcagaaacgtgtttccagaatttgcctgtagaatctaaaagagtggccaagagtctggaaatgcatgaagactggacgtatgtgatggtgggcaaaggcctgactgtgtgtggtgtgtgggtatgtttgcagattcgcgggtgtgagagcagtgatgggtgagggtggccttcaggagccaaggctgagcggtggtgagagaacaagccggaagccagggtgctgtcctggtatgctttggaggaacaggattgcacgtgcgcctgtagggtgacctgtgtgcacctgtgagatgacttagcttggggcttgcaaggcctgggtctgcatgggtgggtatctgaccatgccttttcctccctccctttcacgccgcgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaagatgtggaatcttagagatttattccactggtgtgttaggaccattaaaaagacgtgggcgcccccttccgacagaggctcaccactccaggagaacctgcgggcaggctttcatcgtccgcggagctacaggcttccagcggcctggggcctcgtgggtactgagctgcgtgtgggggtccaggacccgatgtcgcctgccattcggccagggcatcggcagatgtattggtccagcccccgagagacccaggaagaaggcaaggaggttcggtacgagccatctcgaatggaagaagaaggcggtcggtctgcgggagccaggccgcagagccatccgccttctgtccatgtcttctttatcttcctcgccataataattagtggtgtggacccccccacacacactttttttcggatttacttgtatggaacctgtgcaaaaaatatttaatttcgttttgtattaaacgctttcattgggaatcccttcccaat

SEQ ID NO: 373 - DNA, 1500 bp, Homo sapiens
ggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaagatgtggaatcttagagatttattccactggtgtgttaggaccattaaaaagacgtgggcgcccccttccgacagaggctcaccactccaggagaacctgcgggcaggctttcatcgtccgcggagctacaggcttccagcggcctggggcctcgtgggtactgagctgcgtgtgggggtccaggacccgatgtcgcctgccattcggccagggcatcggcagatgtattggtccagcccccgagagacccaggaagaaggcaaggaggttcggtacgagccatctcgaatggaagaagaaggcggtcggtctgcgggagccaggccgcagagccatccgccttctgtccatgtcttctttatcttcctcgccataataattagtggtgtggacccccccacacacactttttttcggatttacttgtatggaacctgtgcaaaaaatatttaatttcgttttgtattaaacgctttcattgggaatcccttcccaattttagtctcccacctatccctggacgaccacattgaaatctctcacttatttgtgtttaaatcacaacaaaatctacaaacctatattcgcctgcagatatttatttttacataagggctatgttaagctacaggaggaaatgttttgcttaccattcggacaaacgtgtgaacacaatgtcacaataggtgaatccagacaatgagctcacagacgaataaacgcagaggcacacacatatactccggaaaataagcagggcgccttttcactaacaaggcgcaattgtaccctgagctgccctccagaccgttcccctccctcagagccaaactcccgcagcgaatctctcagcaagctacgaaatgggatcacagggtcgcgtctacgcgggctccaggcccgaaataatttctaactccaaagcaagtggattttattaggcctccagaagccgaataagggagtagtggcgcaatgcgtagaaactacctccgga

SEQ ID NO: 374 - DNA, 5436 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 375 - DNA, 5312 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 376 - DNA, 2785 bp, Homo sapiens
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 377 - DNA, 2770 bp, Homo sapiens
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 378 - DNA, 2748 bp, Homo sapiens
gctccgggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 379 - DNA, 2736 bp, Homo sapiens
gctccgggcggcgtgcgccgcggtgcctagtgtgggatgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 380 - DNA, 3172 bp, Homo sapiens
caatccctgagtatctcgggaaggaggtgtccggagccgcggacctagagatcccagaagccacagcgcagcggcccggcccgccactatttccaggctcagcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 381 - DNA, 3179 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 382 - DNA, 3051 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 383 - DNA, 4815 bp, Homo sapiens
gtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 384 - DNA, 4671 bp, Homo sapiens
agtgccagaactaactttgactttcactcttcgccaagggcttgcagaacaccttaaaggaaaaaagatggaggcgcttagagttcagatgttcatgccatgctcctttgaaagcttgtatctcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 385 - DNA, 4680 bp, Homo sapiens
cagacctattccgctccatctctgaagtcaaatgggacaccttgaaaatacttcagtggttttcccacgagctattttctctctctgtgaaaaggaaaccaggaaattgactctgtgcctgttttcaagaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 386 - DNA, 4472 bp, Homo sapiens
ctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 387 - DNA, 4454 bp, Homo sapiens
ctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 388 - DNA, 4286 bp, Homo sapiens
ctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 389 - DNA, 4685 bp, Homo sapiens
aatttagccttcctagtgttgagagaaggtgcacgtaagcgtgtggcagaacgtctgcaatcgcatctttgtaataatctcctttctgagacggttcagtggactcaatgttccgccaaagggccaaggcagccctgcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 390 - DNA, 1108 bp, Homo sapiens
ctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaaaaaaaaaaaa

SEQ ID NO: 391 - DNA, 1500 bp, Homo sapiens
aggactggggatttcaactctgagtcttatacctttaaatgccactgtaactctatactgcctccctgatgcctcaaaacacttttgaaaagaaggaacacgtcctactggagctaatcagagggaagaactagaagtacaaatgagccacaacggagagttttaaaattctcttccctaagtgagttccgggaagctcgggaaggggtggacacttgtacagttcacttgtacatcttcactcctgaaatgctaggacaaatctcatttgaactcccagtcaactgagaaattaaaagcagagagcaacgacgctattttgtaactttgtgccttttaaaattaaccgaatctttcaattgctgctgtagattagaagtggctacttggataaaggggaaagagccattcaactgatgaatactattgtaaaagtccagacttagttctagaaaaggaacgcacaagaacaatttctccaataacgttttcattacagagcgaaggaaagttcttcctcgttgttccaatccgaggacaagctgatatgtcgcagcagcccagggaagcatgcgagctgataggaagtccttttattttaagacaggctcgaatgctaaaactttcttgtgccaaaacccttgactattttatttttaaaataagcacttggcgtgccctcgcagatgtctgagctgagaggtcggggcgatggtagaagagcagtcagtgtccattcttattcatattaagtagccaagtctgtacccttgaagcaagtggggagagaggagggagaggagctgctgacattgacaatgaatccaaacaggagttgcactagcggtgtccaccacgttgcctctcccccgcctggccttctgggagctgtagttttcgtgggagcggctccccaggcgagctgggaatgccccgcccgggccgaactacagatcccaggcggcgctcggccgccagcccctcccgcccgggtgcgagtgtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcaggtgagtggtgacagctgggcagaggcgcaccgggcggctggggggcactgcgtctgccactctggggcgaggagagcgggtcgcgggagctctgggacaaggacccagtgcccttgccccggagcagagggcgaactgcccctcgcagttgggggccgcgcctgcccggcccaagtgcgcctttaggaagctcggatggagcgcacttcgcgggggcgcggcgggtcgccggg

SEQ ID NO: 392 - DNA, 1267 bp, Homo sapiens
gcgaaggaaagttcttcctcgttgttccaatccgaggacaagctgatatgtcgcagcagcccagggaagcatgcgagctgataggaagtccttttattttaagacaggctcgaatgctaaaactttcttgtgccaaaacccttgactattttatttttaaaataagcacttggcgtgccctcgcagatgtctgagctgagaggtcggggcgatggtagaagagcagtcagtgtccattcttattcatattaagtagccaagtctgtacccttgaagcaagtggggagagaggagggagaggagctgctgacattgacaatgaatccaaacaggagttgcactagcggtgtccaccacgttgcctctcccccgcctggccttctgggagctgtagttttcgtgggagcggctccccaggcgagctgggaatgccccgcccgggccgaactacagatcccaggcggcgctcggccgccagcccctcccgcccgggtgcgagtgtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcaggtgagtggtgacagctgggcagaggcgcaccgggcggctggggggcactgcgtctgccactctggggcgaggagagcgggtcgcgggagctctgggacaaggacccagtgcccttgccccggagcagagggcgaactgcccctcgcagttgggggccgcgcctgcccggcccaagtgcgcctttaggaagctcggatggagcgcacttcgcgggggcgcggcgggtcgccggggacgaagcgtccaggcgcggggaccctcggccgaggatgccagctgctgagactgattgggggctggggagcgacctggcgcgatgtgggggaggaggagcgccgggccgggacgctgtcccggtgggatgggggagaaagagttctagtgaaccccctttctgaagatcccagcgggttgagggctcggagagggagagctttgggtggactgagatgcgacattggagggaagcaattagttcgcttggagtcacctcttgggag

SEQ ID NO: 393 - DNA, 1250 bp, Homo sapiens
tcttggcaaagctcaccttttctttaatcaatatttgttagtaaacattttaggcatcttcaaagaacttagataacatgtaggagtagttatttggttagattcagttatacaaaaaagcaaatcaagcaatttatttttaaatgtggaaatttgggtgccattaagatgctttgcttcttggcagtgcatatggtggcgctatatttggtggtgatgagtagtgtgcagcataaaatgtaaaaaaaaaaaaattaaaaaaattaagccgcctgataaaaatgccttgatgcaatcaagctgacttattttaattcaactactaatgacttaaatcctgtcacctcttgattttcaattatgtggagtaccattctgtgacttgattatatttgcgcagactcattttatagtttggtgcaatttaggatacccccaaagtgcaaacgaagggtctcattaggaaactaaatgttgtatgcattttggttttcccacagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtacgtgagtgttgctcttgttggttggaccaaactctcttccattttccatttgctaggtgttttgtttatctgaatatgtattttgttagactgacccttcagaattatatttgaaaactccaactcccttaattcttacgtggctttatattttaaaagaaggatgcaaacgcattgtaactgtaatagtaacaatcagtaaatggtgggagtcaatgttccatgagaaattgcaagtaggaatacatgtttgttgtgatgacatctttctttgggaaagtttcaaaaccagaattatctgaggtgggcctcttctgataatttgtgtatcttaaatatttttctcttaaataccttccatagccactctttacttttctttttatttagtatgtaatattggttgtaaaatctgactgttttagagagctcttcacatataagattgaagaagagctttctgcgctttgataaccagactacataatccttttact

SEQ ID NO: 394 - DNA, 1228 bp, Homo sapiens
tatttattttctacagccattttacacagttggttcttaaggaggtgtgtgtgtgtgtgtgtgtgtgtgtgtgtgtgtgtgtgttttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggcttaataatttattctgttggtggcctggtcagtttcatgtttgtgcctgaaggaagagccgtctgaaactcacaaataacagcgctgttttcttttccctccatggctatgttcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagaggtaattcatgtctcctctcctctcctgttttcttatgctaaataacttgtctgttgaatatgattcccacacttaactgtggactctagtttgtccttgtggccacatttaccagcctttgtccccgattcaccatcgtggctgtggcattccagcctgttgtctccatcgctgggttattgggtgtagagcacatgacgggagacctggccctctccaagtgaaatgtggaggcgaggacacttttgccacttgcttcttcttccttagctgagtgctctcttctcttccatgcctttcagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgaga

SEQ ID NO: 395 - DNA, 1084 bp, Homo sapiens
aataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaagttatagactgtttttgcttgtgtttttgcagggattttataagtttgaagagcaaaacagggcagagagcgagtgcccaggcatgaacacacattcacgagcgtcctgtatgcaggtactgaatgacttggcagcctgaggatgaacactttgtaatgagaatctatatttgtggtggatcacaccttcctgaaaacttaagcatttttttcccccattgttttttttttttttatagagaaagctaggaacattgccattttcctcatagtatctcatgattaaataatgacaagggagaataaactaaaatgtgtttttcccctaagttgctgcaaagattaaaaacttcttaaagtacataaattttaataagatatgaaatatgtactttaacataatccatatatgttatacaaatttgtaggttagcaatttttgtattagtaaaaccaagatgtgtgtgtataatctagatattgtttcctaaatggaatctcatggaacatacattttgaaactatattaatttaataacatataatggatgctttcccaaataactaaagtttcttctactacatcctatttaatggatatataaattatgctata

SEQ ID NO: 396 - DNA, 1096 bp, Homo sapiens
aaaaaggaagtagaatgacagctgtcattcaagatgaagtgctgtggtacatctctcctgtttagggcaggcagtttagcatagttgtgaaagcatgggttaaattgtggctccagtctttcttcagtgtgtgactttgggcaagctgcttctcatttatttcacctggaaaattgctataataatagtacctgccatgatacggttttcgttagggcaaaatcttagcctatgaaaatcctcgaacccaatgcttggcaactcataatcactcattaaatgctggctacaagtattatcctcatcacctattcgtgttaatggtcttcaatactattttatacttcaatactattttagtggaaagaggacagttacttcttagaatctaactaaagaccattattgctttgggtaaaaaaagaccatgagtctctttttaggttgtgttgcatagtttatttatttttgtctctcttctcttaccctttttcctacagatggatgatgtaatcgatgacatcattagcctagaatcaagttataatgaggaaatcttgggcttgatggatcctgctttgcaaatggcaaatacggtattgataacctttttttaagtagaaaatcttgaggtgtttccagggttcttttcttttttcttaaacttttattttatctttgtaactggttcactgattaaatgtattaatagtaaaatggagaattatctcaggatcacaaataagtgactttaacatcagaaattaagaagtttttatgagtttatgaataatcccatgataaaactctacattccctggagtccacgagcagttttgatagggcattagcccttccaattcccttgacatctaatgcccaacccagtacactgcagccaagggaaccattgtgaactgcactattcacagtggtgctctagttggcctgaaaaagttggttcagtttttcaagaaggttttctcatattcttaggtgatagagggacattggagttacccttctccaacagcaaaatctattccaacctcagttcataaacaagtggtcctatttgctattgtatgttacttgt

SEQ ID NO: 397 - DNA, 1118 bp, Homo sapiens
aaaaaaaactttcattgcttttccttgtaaaagaaaaagtgagaagaagaggtggatacgagaaggaaggaacaaaattaactttaatggaaagtcctatttggtgaaaaggtcattttatatacaatcctgttttacaataatagccaacatttcctgaacacccactgtttgctactagttgtactagataatgcattcaccacattattcattgcctccatgctcaaaataaactgactggctagttagagtagtcattttatgggtgtgagactgtactttcctgcctcaaagggaactggttgaggagatcctgtacctctcttttaatacctgtgaatgaaaaagtaaacatctcatattttcctattttaaaaatgattttttgtatcaaataatttttcttaaataaatcctagagtaggatataggttttatctgaaaaaacatgggaattgttcaacagttaatttctgttactgtttgtctctctctagttgcctgtctcgggaaacttgattgatctttatggaaaccaaggtctgcccccaccaggcctcaccatcagcaactcctgtccagccaaccttcccaacataaaaagggagctcacaggtaaacacctagtaaatgtgcctcttactgcagatttctgtccatttcctgataagacaaagttattgatatagtgatgtgcaaactatatccaactcatggacgtaacttttataggtctctgcagtggttaaaacattatgcaatattttaagacggagaatttatacttgaaaattctgttttttttcaaggagatccttgaaaatctcctgagatactgggaatcggggccaccattactgcatgtcaccaatcactgtgtgtgtggtgaaggtcccctttgtgttggggatagtaggcaactctttcagctgtaactgtctccaccctacctgatatgtatgtttctaacaagcccctagaggcatttgcatttgagaacccagatctgaattttcctttgacacacattcaagcccacaattgggatagcataagaatatatttctcacatcttcagatgcctcctgttgtcttttgctgtattgtgtgcaaaa

SEQ ID NO: 398 - DNA, 1057 bp, Homo sapiens
tccacttcccaaagtgctggaattacaggtgcaagcaaccatgctgggccactactcagtttttatatcagcacgttacacaggcatcaaaaaaggattgaaagcttctatggcctgaaaagaaaatatatcagacccctgataatagagtatcaacagcaaattgacatagttttctaattatcgatttctttcttgctagtatctgtatatgtttacagtgtgctatatataatttttaccagggtttttttttaccattttgtggaagcccagtttttacatattgtatatatgatatatatattgcttttgaaaacatgcaagctttttaaaaagatatcatttttaaaaaaacgtatttttacttagagtcaagtcaaataagcttctgtatgtttgggaaatgagatattttgtagtttacattttgtgcaacttcaaacagttccaacttctaatgacttcattcacgtgcacagcgtgtatttttcccacagagtctgaagcaagagcactggccaaagagaggcagaaaaaggacaatcacaacctgagtaagttggttttatttatgttcatgacatttgatattaatgttccccatatatcaaaaatgtttccagaaattctgtagaggagagttgattcctacagctgttaaaattctctcttatggaagaaaattgtatttgacagaaaccaaggtatatattttccccatattttatctcagatcaaattgaattttgtatatatacttattttcagtttctgaagagtttttatttttcttgtttctagtagtggttttctctctctctctctctctttttggtaagagggagaattgatccccaactacccaattataagtgttgctcacactggaacttattaacaaaaggggattagggaagcaccttctccaatgagatttgaaagaaaaagaaagaaagaaacagatctgaaggggagtaaatggatgaggcagcctcctaaatttctgacatgattcgtgacttaaaaaaaatagccctaaagcatttaaaatatt

SEQ ID NO: 399 - DNA, 1076 bp, Homo sapiens
gtcagtaaaaaatgtgtggaaatttgttttccctccgcttaagtaaatatctgcataatatcctcaattttgctacttatcccacaaagccagaagtactaacttcctggctctttgcagaaagtttgctgacttctgctctaaggggttaggttagaatttgggctttcaccagatattgttggatgtcctcgccaagtccctaataacagtatctccaaggcaatttcattatttgtaactaaggatagtaactgatttcagggttgttataagaacaaatgagaaatcgtctgtatctaagggctttggaaatggtaaagaaatgtagctcatttttaactgcaataccaagaacatagtaaaaatagggaaaaagtaggttcaggtttccgttgtcatgacctggagaagttaatatgcacatgcctttaatgagatgtgctaaatgcatacatggcactgttactaatagcctttcctgtgctcttttcttgaagttgaacgaagaagaagatttaacataaatgaccgcattaaagaactaggtactttgattcccaagtcaaatgatccgtgagtacaatcgcgtgttaatctgcatcatatatttttcgtacctgaatgttttttcatacgttgtaaaaaatgcagttgtaaaaactaaagtaaagaagtctcccctctccctttggttctattcctaaattcttcttacacctttcttttggttagtctcatcaagctaaaatttcaagacaaaagcattgaattgtgcaaaaggattgttggacactagatgttttggttgtgaggaggtggctttctgaaacctaagaattctttgcaaacaaatactgagcttaaaaaaaatttcctttaatggttcatgcagaacagaactttcaatagttgttaaagctagatttgttgactgtttgctctttgacttgtacagtacctctaaataggcactgatgaacagacattagagacttaaagtttaatgatactccacagacaaaaagggtcaattatttttatgaaaacttgcctactctttgtatgttttacca

SEQ ID NO: 400 - DNA, 1148 bp, Homo sapiens
tagtactgtgtggcctaggacaagttgaattgtgtctgtttcaacatgtgcacagtctctctcttacaaggtgcttgtctgggttaagtaagacaatgtgtacaaactgggtgggcaacactaggcacgtggcaaacactcgtgaatggcagctataattaatgtatgattattttatttttaaaattgaatgcttttaaaaatgatacaatggactttggggacttgcggggaagggagggagggggtgggatgggggtgagggataaaagcctacacgttgggtacagtgtacacggcttgggtggtgggtgtaccaaaatcgcaaaaatcaccactaaagaacttatccatgtaaccaagcaccacctgttcccccaaaactattgaaataaaaaaaaattttaaaaagttcaaaaagaaatggagtgctttgaatattgaattttcattgagcctcaaatcctaaaaatatctgttttcctccattttcatcgcagagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggtacgcagcctgagttgtgtaaagtttactgctttttaccgacttcaagacagtagaaacagggatataatgagccataggggagttgacttacgtgatcctaacacagtcaatccttattatttgtggattctgtgtgtgtgaatttgcctacttgtaaccccaaagtcagtatctgtggcacttccacagtcattcttggacatgtgcagagtggcacgtttgagctgcccatggcacgcatttccaggtgaggtcgaatgaccctgcctgaggttgactgtctgctgtcttgtttcagctctcatcctctaaacaagtgctcctttcgtggtctgttgagtactttctacatttttgtggtttctgttggtgatttcgctgtttaaaatgacccccaagcataatgctaaagcactgtctagagttcctgagggcaagaaggccgtgatgtgcttacagagaaaatacatgtgttggataagcttcgttcaggcatg

SEQ ID NO: 401 - DNA, 4491 bp, Homo sapiens
tacataatcaaatctataaaacacctaaaaatttatttcacatactgccagtggtacttctcctatactttagaacatacagagctcattaatttaaaagaacaaaaaacttttattttgaggatttattgttttccaagtatctgatttttaaaaatagactttatttttcaggacagtttttggttcacagtaaaattgaaatgaagctgcagatatttcccatacacctcattcccccaagcacgcacagccttccccattatcaacattccctaccagagtggcacatttattagaatcaatgaacccgcagtgacatttcattatcctccaaagtctatactttacattccctctggtattgtacattttgtgggtttggccaaatgtctaatgacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatagtggtggcctattgtgttaatgccaattttgaatgctatctgccatatcaaaaaatggtagtgcacattttcttctgatttaatgaataacaaattgcatgaaaatttagaaaatgccagtaagtactttttttgtttaaaatgccactctaagatgttactttttggttttaaacatttttgattactttttgacttacactcagatgaggtgtaattatgcaccttttttatccccctctgaatttggggagattttaaactcccaaatgccaagacttcattttagatataggagttttatttaaaatgtttcattgagaggtggctttaaaaaagagaaattgtcagagaaacccttgcatatttacagaaaagatattgggtttttaaaatacaaatttacaataatgaaagcttaatatacccaggctgccagctcctggttgccttttttttttaatacactacttaagaatcatttgataaatgttggatttg

SEQ ID NO: 402 - DNA, 1500 bp, Homo sapiens
gtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatagtggtggcctattgtgttaatgccaattttgaatgctatctgccatatcaaaaaatggtagtgcacattttcttctgatttaatgaataacaaattgcatgaaaatttagaaaatgccagtaagtactttttttgtttaaaatgccactctaagatgttactttttggttttaaacatttttgattactttttgacttacactcagatgaggtgtaattatgcaccttttttatccccctctgaatttggggagattttaaactcccaaatgccaagacttcattttagatataggagttttatttaaaatgtttcattgagaggtggctttaaaaaagagaaattgtcagagaaacccttgcatatttacagaaaagatattgggtttttaaaatacaaatttacaataatgaaagcttaatatacccaggctgccagctcctggttgccttttttttttaatacactacttaagaatcatttgataaatgttggatttgaattgggaagtgtcagacaaaacatgtctttattccctagctagaccttaaacttctgcccttttaaaaaatatattctggcttaacctctggagaaaatgagcaagaaacttcctgtaatgcttctgatctgactgtcagctttttcctacttttaattttcttcttaaattgtaatatacaataatcaaggcctttcttttttagacctatttgaattatttatattttccctagaagtataactgtaggatcccttaaaaacatgtaaaagtagaaagatttccttttggaacaagagagaatattctgggcaaaatcaaaagcaagtaagttgaaaattggggcttttcatctccgggggatctgcagcaataccttcacccacatttctgtcctgatatttaccagtaaatagtcatttcacagcccataagaatccttcatctttagcttcccccacttacacacagacacacacacacacacacacacacaca

SEQ ID NO: 403 - DNA, 2662 bp, Homo sapiens
gaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 404 - DNA, 2473 bp, Homo sapiens
acaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaaaaaaaaaaaaaa

SEQ ID NO: 405 - DNA, 2473 bp, Homo sapiens
acaacggcggaggccgccgggttccctgacgtgccagtcaggccttctccttttccgcagaccgtgtgtttctttaccgctctcccccgagaccttttaagggttgtttggagtatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaaaaaaaaaaaaaa

SEQ ID NO: 406 - DNA, 2386 bp, Homo sapiens
acaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaaaaaaaaaaaaaa

SEQ ID NO: 407 - DNA, 1500 bp, Homo sapiens
ccaaccattctctgcaagctaagccctgctgtctgcagggactctaggattgccgacatgagcgcaccaacactgaaatgatgagtcaggttgattatggtcagaagatcttcttgcacctccaactcagggcctacaccgcggataaagaccaggaggtagttctcataggccacaaaagcctggtcgtccaaggcaagagaataggctttaaagtccctggctcggttaaaaagctggttgcgtagattcctgtcaatgctcaggatcctctgccttgtgatatctggagataagtcaacgccttgcaggacgcttacatgctcgggcagtacctctctcagcaacacctccatgcactggtatacaaagtccccctcaccccagccgcgacccttcaaggccaagaggcggcagagcccgaggcctgcacgagcagctctctcttcaggagtgaaggaggccacgggcaagtcgccctgacgcagacgctccaccagggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttct

SEQ ID NO: 408 - DNA, 1314 bp, Homo sapiens
ggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcac

SEQ ID NO: 409 - DNA, 1091 bp, Homo sapiens
ggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggact

SEQ ID NO: 410 - DNA, 1099 bp, Homo sapiens
tgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaa

SEQ ID NO: 411 - DNA, 1074 bp, Homo sapiens
ttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacaga

SEQ ID NO: 412 - DNA, 1073 bp, Homo sapiens
tgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtct

SEQ ID NO: 413 - DNA, 1092 bp, Homo sapiens
gtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatg

SEQ ID NO: 414 - DNA, 1043 bp, Homo sapiens
aacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatag

SEQ ID NO: 415 - DNA, 1089 bp, Homo sapiens
aaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgc

SEQ ID NO: 416 - DNA, 1113 bp, Homo sapiens
accttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaatt

SEQ ID NO: 417 - DNA, 1094 bp, Homo sapiens
ggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccct

SEQ ID NO: 418 - DNA, 1154 bp, Homo sapiens
tgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccaggga

SEQ ID NO: 419 - DNA, 1371 bp, Homo sapiens
ttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatccc

SEQ ID NO: 420 - DNA, 1149 bp, Homo sapiens
ggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgt

SEQ ID NO: 421 - DNA, 1109 bp, Homo sapiens
cccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagt

SEQ ID NO: 422 - DNA, 1064 bp, Homo sapiens
atcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccag

SEQ ID NO: 423 - DNA, 1165 bp, Homo sapiens
aaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatg

SEQ ID NO: 424 - DNA, 1093 bp, Homo sapiens
aaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgg

SEQ ID NO: 425 - DNA, 1114 bp, Homo sapiens
cacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatca

SEQ ID NO: 426 - DNA, 1361 bp, Homo sapiens
tacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcacaggctctgatggcactgaccatggagaaagcttgatttgatcatctggtgtctacaataaccaaagctaattattaaggaaaaaaacttgaagaaagaaaatagtccttacttcatctataatgaggtttttgtttttttgttttgagacggagtcttgctttgttgcccaggccggagtgcagtggcgcgatattggctcactgcaacctccgcttaccgggttcaagcaattctcctgcctcagcttcctgagtagctgggattacaggcacctgccaccacgcccggctaatttttgtatttttagtagagatgtggtttcacgatgctggccaagctggtctcaaactcctgacctcaggtgatcctcccacctcagcctcccaaagttaagtgctgggattacaggcatgagccactgcggccg

SEQ ID NO: 427 - DNA, 1500 bp, Homo sapiens
ggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcacaggctctgatggcactgaccatggagaaagcttgatttgatcatctggtgtctacaataaccaaagctaattattaaggaaaaaaacttgaagaaagaaaatagtccttacttcatctataatgaggtttttgtttttttgttttgagacggagtcttgctttgttgcccaggccggagtgcagtggcgcgatattggctcactgcaacctccgcttaccgggttcaagcaattctcctgcctcagcttcctgagtagctgggattacaggcacctgccaccacgcccggctaatttttgtatttttagtagagatgtggtttcacgatgctggccaagctggtctcaaactcctgacctcaggtgatcctcccacctcagcctcccaaagttaagtgctgggattacaggcatgagccactgcggccggcattaagtatgagtttttaagttagcccactttgttaatgactatgagtactaatagcttaagataaagaagtttctaggtaatcttgtttgaaggatgatgtaaaaatataaatttaaactgtgagtgacaaaataaacttccttaatatttgcctacatttagagaaatggagcattcagctcagaaaggaagaatgtctgtggttttaaggtaaaatccatattccaagactcagtgaagaaagttcagtgataaagaacagactactctcatcttatgaagaaatggagcaatttcacttggaaagactaggaagacaaaatgttacagacgtatttgttgtgccacaaaataggcaaggtcagttttgaacaataagaactccataaagtagaccagggcatctcagaagtgaggttccatgagcccaggtggggcacaggctgggtgatcttgagtggagaggaagaggggttttctgagcttcaagagctgg

SEQ ID NO: 428 - DNA, 7897 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttca

SEQ ID NO: 429 - DNA, 7825 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttca

SEQ ID NO: 430 - DNA, 1500 bp, Homo sapiens
gaagactggttggttgggtttggttagtcactaaactagcatatatcaaatgcttaccaggtctgacaaattcgttataaattccactttaaattctcaatgaaaatgagatagaaagcaaaaactaaggactggttaacaattccaaaacactttattctcacagcattctcagagttctgctctcctttagttatttttataactaaaagctgtggtggcactggggagattcaagtcagtgaagagagtcttggtgttgtcatctgtaaattaagagttgagcaaaggccgggtgcggtggctcacgcctgtaatcccaacactttgggaggccgaggcgggcagatcacctgaggtccggagttcgagaccagcctgaccaacatggagaaacccccgtctctactaaaaatacaaaattagccgagtgtggtggcgcatgcctgtaatcctagctactcgggaggctgaggcaggagaatcacttgaaccctggaggcggaggttgcagtaagctgagatcgcaccactgaattccagcctgggcaacaagagctaaactccgtctcaaaaaaaaaaaaaaaaaaaaaaagagttgagttagacagtttctcagccttttccagctccaaatgccataattctaagatggcaggctctggaattattcattcattcggtgcctaccataggccaggcactgttcttggtaactgggatacagcagtaaacaaaatatataaactccttaccttcacatagcttacattctagggagagaagacaataagtaaacacataaaatatatattgaattaaacggtagttaagagcaaaggtgaaaatgagaaaaaaaaggaaagggaaaacacgggaaaaaaaaataaaaacaaaagtaaaagctacgacatagtctttaacaccatgccaaaagggaataaggattgagactgtaggtaccggttcactgaaccctgggatgcggatccttggctggaacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggtgactctgggggaagcacgcgacgaaaagatgatgccggggtctcttctaacaccagaagggccctgatgatggctgcgcgcagctttcggagccggatgcgcgagggccccggaggcccggcggcctggcggccgggcgggcccagtttggggacaaggacggggctggccagggaggggctgggcctggcgggaaggcagcgctgccccggactcggcccgcgcggccctcccaggcccccgtgccctggatccaggcccgtgcgtcccgtcagtcccaggcgctgggaggcgtcatcaggaaatcattgggtttacattaatcggaatacttgttaaacgttt

SEQ ID NO: 431 - DNA, 1153 bp, Homo sapiens
ggcggaggttgcagtaagctgagatcgcaccactgaattccagcctgggcaacaagagctaaactccgtctcaaaaaaaaaaaaaaaaaaaaaaagagttgagttagacagtttctcagccttttccagctccaaatgccataattctaagatggcaggctctggaattattcattcattcggtgcctaccataggccaggcactgttcttggtaactgggatacagcagtaaacaaaatatataaactccttaccttcacatagcttacattctagggagagaagacaataagtaaacacataaaatatatattgaattaaacggtagttaagagcaaaggtgaaaatgagaaaaaaaaggaaagggaaaacacgggaaaaaaaaataaaaacaaaagtaaaagctacgacatagtctttaacaccatgccaaaagggaataaggattgagactgtaggtaccggttcactgaaccctgggatgcggatccttggctggaacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggtgactctgggggaagcacgcgacgaaaagatgatgccggggtctcttctaacaccagaagggccctgatgatggctgcgcgcagctttcggagccggatgcgcgagggccccggaggcccggcggcctggcggccgggcgggcccagtttggggacaaggacggggctggccagggaggggctgggcctggcgggaaggcagcgctgccccggactcggcccgcgcggccctcccaggcccccgtgccctggatccaggcccgtgcgtcccgtcagtcccaggcgctgggaggcgtcatcaggaaatcattgggtttacattaatcggaatacttgttaaacgtttacccgtcagttgctgccggctgcttagtgcattagcttagaaagcagcagaaattctgcagttaagagccctgatttgtcccgagtttggaaaaccggccccaccgcctgcaggggcccacccacgtggctctcactgatggagaagaagggg

SEQ ID NO: 432 - DNA, 4343 bp, Homo sapiens
tttgattcttaaaatttcttcctattgcttcaccttattacaatgtcttagcaattcattataagtatttttctaaaagtcatggttattgtgtaatgtataaatgttatgaaactagcttggacatttttgtcatgaataatttctagctaatgttccttagctgtatttaatttaggcatctgtttttggtgaagtggttagaatttcgaatactgtgtttactggtcaacttcaagtgtaattatgatttcactttaggacatgtgggatttagaaaggagcattgaaaattatgaaattatgaattttttttggatgttaatccattgcaccaagcatgagctgtgcctagagatcagcggtataactttgttttgctttgtttcacaatttggtttaataagagtgatttcatttacctcaagtgctatttcttcataatgctgtgtaatgctaaagctttgattatgtgcgtgtgtggtttttttctccaataggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatggtaagtacgtagtattcatgtgcatgagatgcttttgaagatgggaatgctggacaaggagtaagatcctcattatccaaagagattatctcaacagatagaacattttgaagaccacttataaaacatatgttgtattttcatgctatatgaagatttgctacgtccaacactacttttttttttttttttttttgagacggagtcttgctctgtcacccaggctggagtgcagtggtgcgatctcagctcactgcaacctctgcccccctggttcaagcgattctcctgcctcagcctccagtgtagcttggattacaagagcatgccaccatgcccagctaaatttttttattttcagtagagacaggatttcactatgttggccaggctggtctcaaactcctagcctcaagtgatccacctgcctcggcctcccagagtgttgggattataggtgtgagcccgcacgcagcctctaggtccaacactatttaaat

SEQ ID NO: 433 - DNA, 1099 bp, Homo sapiens
ggtgaaaccccatgtctactaaaaatacaaaaaaattagccgggtgtggtgacgcatgcctgtaatcccagctactcgggaggctgaggcaggagaattgcttgaacccgggaggcggaagttgcagtaagccgagatcacgccactgtactccagcccgggcgacagagcgagacgccgtctcaaaaaaaaaaaaaagggtctcaagacattgccaatgtcccctcgtgcaaaattgccccccagtgagaatcacagtgacctattctaggtcttcattctgtctggtatgaatagataatggaactaagcattaatatagagtcctatatggacagcataatttcattaaaggatttctgattctcaatctagtgtttagtagtctgctttatgtcttgactcagtttgtgcagaaagaggttttatgtgattaaatttttaaagagtttacttgtattttaagttcacatttctaggtttttctttcttatatttagggtctcagtacaggtgtcaaccttttagaagcgaccttgttcttcctttccttccgagagctcgagcagagaggactgtgatgagacaggataacagaggtaagggtggcagagagtgctggggcacacagtacacatcgtaccacctaactcaaaaaacaaagcaggcttgcattaagcttgatcagtgccagctgtgctgtactggaatcaggaattccccacggccctgtttaacagcggaactaattaattcagcgcatgcatttaggtcagaaattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagt

SEQ ID NO: 434 - DNA, 1086 bp, Homo sapiens
aattacttttccagacttgaggtcaatatttgctgattatgcatagtctgtggtgtcttgtgattaggggacatgtttcttatttttaaaaaggctggacttgcactccaagttgctgtagttttatgtaagcaaaactcttcaaaaaaagctacagacatcaattttgtgtgtatgtttaaaaatagataaggtatattttgcttaaaggcagtaaggctataaatttgagccatagcttctctgtcagtattccacaatatctcttttaacagtttggagaaaagctgtaatgccagaagatacagtcaccaactctagtttaaaaagtaacagatcaaaataatttagagatacagcaaacactgaacatttgtagaacatagaaacaatgtacgtgacctttggtcttgaggctatggctcaccaaacaggaaatgccattccctcctttccctgtggttctggatgccaactttacctgttcccttttgccctagatactgtggatgatactgttagtagcgaatcgcttcagtctttgttctcagaatgggacaatccagtatttgcccgttatccagaggtgggtctgtagcagtttttctttgccttttttttttcttcttcttcttcttattttttaaattttgagatggagttttgctcctgttgcccagactgaaatgcaatggcatgatctcggctcacgtaaccttcgcttcccaggttcaagcaattctcctgcctcagtctctcgagcagctgggattacaggcacctgccaccacgcccagcgaattttgtatttttagtagagatggggtttctccatattggtcaggctggtctctaactcccaacctcaggtgatctgcccgcctcagcctcccaaagtcctgggattacaggtgtgagccatcacgcccagcctttctttgcctgttattttaaactttgagtttcaagatgggtacagtggcatgcacttatagtctcagctactcaggaggctgaggtgggaggatcacttgaggccagaagttcaaggctatatagtgtgctgattgcacctgtgactagcca

SEQ ID NO: 435 - DNA, 1105 bp, Homo sapiens
gtaagactcattattcataaattcttttgaatttttttttttttttttttttttttttttttttttgtgacagagtcttgctgtgtcgcccaggctgaagtgcagtggcgtgatctcagctcactgcaagctccgcctcccgggttcacaccattctcctgcctcagtctcccaagtagctgggactaaaggcgcctgccgccacgcccagctaattttttgtattttttagtagagatggggtttcaccatgttagccaggatggtctcgatctcctgacctcgtgatctgcccgcctcagcctcccaaagtgctgagattacaggtgtgagccaccacgcccggccgattcttttgaatttctataaattccctgaattaaacccacctctagtaggctaaataaaaatgaatgcttttaaagcactctgatatctttggtaaaacaattctgacacaaaaattaaaatttcaattatattttgctgagtctttctaggttgctgttgatgtaagcagtggccaggctgagagcttagcagttaaaattcacaacatcttgtatccctatcgtttcaccaaaggaatgattcattcaatgcaggtaaaagattaacttcaaaatctcataaatatatatatatatatatatatatatatatatatatggcctaactcttctaaaatttgatttatttaatgatatagaccaccttggtcaaggcacgtgtgtgtgtgtgtgtgtgtgtgtgtgttcttactagaacttttatcatcagaagaaaaagcaagggattaattataattacaaagaaagaaatatctttagtagtgtaagtaggtttggagggaatgaattatggattcaggctgacagtttcaaggattctcaaggttctcctgcagaagattatatattgactttatatttggcaataatttataaatcaaagtcctttagtgaccttgtccttaagtgtgcaacagtgcccttttagaaattaccttctattgtgtgagcctacacaggtttgggaaagcccatattgagaagtcatttcacaaaagggaccctttgtctgatctgcttttctattttgcctt

SEQ ID NO: 436 - DNA, 1073 bp, Homo sapiens
gagccgagatcacaccattgcactccagcctgggtgacaaagtgagactccgtctcaaaaaaaaaaaaattaaaaataaataaaaataaaaatagactagtttctccataatcgttttccttgctttcatataaattttaaaaatttatttcagcctgtatgttagcaatctctggtcacattacctattctcaagagtcactctgttgggaacatctcaggccttctctaaagtattgctagcacaccactctgagacgtgggagtctgtcttcccctgtcgcctccctccccttacatcttctgatcaactccacctgcccattctttcatccttcctagtgactttttctggttcatcagaaccttacccagtctcaaagaaaggagtgtgataaggcaaacaactctaaataaaatacagttctgtatctttctatgcaaataagcctttgttaatttttatttagtgttgtaccacttatttgaatgtctgacaggttctccagcaagtagataacaagtttattgcctgtttgatgagcactaagactgaagagaatggcgaggcaggtaagaatggagtttagcctgaatgattaaccagctggtcttcttgtaacctttttttaatgattatttttggtatataatatagtttcaatgatttggatggattagggaaagccaatctaaaactaagaatattatgaaggctgggtgcggtggctcacacctgtaatcccaacactttgggaggtgaggcaggtggatggcttgaggccaggagttcaggaccagcctgagcaacatggcaaaaccccgtctctactaaaaatacaaaaattagctgggcatggtggtgtgcacctgtagtcccagctactcaggaggctaaggcacaagaatcgcttgaacttgggaggcagaggatgtagtgagccgagattgcgctattacactccagcctgggcgacagacatttagttttatgttcatacacatacatatactcaggatgcacattaaactatcaagagtatttactttgggagtgaaaatgagggtgtgca

SEQ ID NO: 437 - DNA, 1072 bp, Homo sapiens
gatttcttgacctcatgatccgcccgcctcagcctcccagtgtgctgggattacaggtgtgagacactgcacccagccctgactatgttttctaaatgagatgctggtgaactaaagagtttcttagtttaccttttgtttcctaaaaaatgaaattatggggaaaataataaaacttataggataaaaattagtaatactggtaatctctggagagagaaactagaaggggtgggggcaagagtataaaggagactttattaaattcccttttgtgcctttcagaattggatctgggattcaaacatatgggataagtttgctatcattttccccataatttcatgttttaggaaataaaagatacaattgttactcctcagaatgttttgtcttatgctgttgttagatagtttgaattaagtcttctctgtcctcaacacacatgatggttgtcgtcttgctctgagaatcaaagttcacaatccttgctcatctaggtgggaacctgctcgtgctggtggatcagcacgctgcccatgagcgtatacgtctggagcagcttatcattggtaaggatctgtttgcagccagaaaaaatttgagactcccagcagaatcagtacacctcaaagagcttttctaactgcaactgttgtgagaaagcacactttgtactgtatgttcaaaaattaaactaaagtcctgcagtttggcctgtgttataattgaaagaatgtggtagttcactaattgaaagatgtgaacttatttatgtggtcagaggcatatttgccagatgttattaacaacccagaagtacgcaaggataggctgcttactctgacatccagcacaaagctctgcccctccatatgcccggtgatcttggcatgccttcccacactccatcaggcagagaccagtggcagctcagaaggcccagtatgctgttttgattttaaaatttagtttgcttttgaatatgcagtataatcaaatagatccaattctgaaaggcacaaaagggaatataataaagtctcctttctatccttgtccccacccctcc

SEQ ID NO: 438 - DNA, 1112 bp, Homo sapiens
ttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtcagtaccaccatgagaatgtgatgttgatggtatcaattctcacaataattctgtgaggaataagcataactattgttccatttctcagatgagaccaagagaggttacaagacttgtctaaggtcatagcagttattaagtagtggagcaggcactcaaaggcaggtcgtctgactccacaggctgtttgtttccttttttaaaatatatttttttctgcatccaatcatccattaaaatatttattttgtgagacatggtctcactctgttgtccaggctggagtgcagtggcacaatctctgctcactgcaacctccaccttccaggctcaagcagtcctcccacttcagcctcccaagtacctggaactacaggtgagcaccaccatgctggactaatttttgtaattttttggtagagatgggttttcgccatgttacccaggctggtctgaactcctaggctcaagcgatcctcccactttggcctcccaaa

SEQ ID NO: 439 - DNA, 1160 bp, Homo sapiens
ctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgcggtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagt

SEQ ID NO: 440 - DNA, 1024 bp, Homo sapiens
ccaaaaagcccgtgggaactaaagtgactgtttacttatgtttatgatatttaagcaagtgttatactgagcagtggttgtgttgatggttgttgtgtatttattctcagtttgtgtgtaatattacgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccgttttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacaaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagag

SEQ ID NO: 441 - DNA, 1079 bp, Homo sapiens
cgcttgttctggctaagattacacacacaaacagacagccttttagtgagaagccttcctgatgttttgaattggttgaatcatcaaggctactctcaccagctacataacctcattagttgagaagctatctctggaggaagtctcagtagctaaatatattctgtgttcaataagagttctattcagttgcttggttttttcatattcaaagtgccttacaacaaataaatttgtacccaagtgctgtattgctggaactctttctttcaggaggcatgatttaaagaagaaaattgagatattttgtaaactatcaaagggcaagtaaaacataaccgtagattaaagccgattttccttttgctttgcaggaatttatccgagaacaactggaggtaagcttttcctttattttggggtttcacacagaagcaccacacataaaaggcttcgttgttccgttttcttttcctgttaataacgtgtttatgcattagctactccagaccaccggaggcatccaagggacattgccactgactgtccagaaggtgttggcatcccaagcctgccatggtaagcccttcaacatagcagtgatcaaacacctctgcatgcagagccctggcagggctgccgggattacaaaagaggcagagggtacatttactacttgactcttggagaatacaatttagatcaagaaactgaatatacccttttaaaaatcacttttacaaaaacaaaatcccaacacaaaaatttgactatagtgctgcctgacctatatgagtggaggaataactcctagaggagatgcattttgagatgaattttgaatgagctggggaacatgggttcatagcatggaaaggggaattcactatagggagagtaaacagcctgtgcagagaggcagaacagaaacaagttagttatatgagaagcagcaaagagtatcaagaaactaggcaggtaagagaacagaaacctagaaggtcacagcaaaacctttggatttgatacagaaggcattagaattagcaagcgttctttttttatctttccaactttca

SEQ ID NO: 442 - DNA, 1152 bp, Homo sapiens
agccttagtttcatccatggtcataagcactaatttatttccctctttttttttttttttttttttttttgagaacggagtctcgctttgttgcccaggctggagtgcagtggcgtgatctcggctcactgcaacccccgcctcctgggttcaagtgattcttctgcctcagcctcccaagtagctgggactataggcgcgtgccaccacacccggctaatttttgtatttttagtagaggcgggatttcaccatattggccaggctggtcttgaactcctgacctcatgatctgcccgcctcagcctcccaaagtgctgggattacaggtgtgagacaccatgcccggcctataagcaccaatttcaagcaggattaaagcttcattaaagaagcctaagaaacatgttactttttccagatatttggcagtgacccaaggtcagcattggtttcccactatatacactataaccttcttgtttctgtctttcatttaggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacaggtacattaatgactaacaggagcaggagggagcaaagtttattttctctttcttttctggcttttactatgcaactgtaatctgtcttaacctttccaaaataggagagttttgcaaaatctgcactggaagtttcacataaagcctcacccatttcattttccagctcaaatccaaaatggaacttagactgaactgtcaggtcacctacataatggctttgtattttaaaacttaacacatgtacagacttatgtaccctgaatatctattgcctgctggctctaggtttcataatatgcagttctttctgaagctactgaaagttggtagaagcacagcaaattcactgttggcaatatagagcctcaacttccagtttcttgatagtacctgctggaaacggtgatctgtgactgtagctggccatccccaaggatcttgagttatggtttgaggatcatcagacagggacccaagcttggggatctctacattat

SEQ ID NO: 443 - DNA, 4438 bp, Homo sapiens
gctgagagctgggaatctagacttaaagttctgagtccccttggatccttaaaacaatctgtaatctctattgaatccagaagttagaaatctaaacagattataacagccagactttggaaatatttgtatgctacctacattttcaattttttttttttgagacggagtctcactctgtcgcccaggctggagtgcagtggcatgatcttggctcaccacaacctccgcctcccaggttcaatcaattctcctgcctcagcctcctgagtagctgggattataggcatgcgccaccacacccggctaatttttttttgtatttttagtagagacagggtttcaccatattggccaggctggtctcaaactcctgaccttgtgatccgcctgccttggcctcccagagtgctgggattacaggtgtgagtcacctcgcccagcctgtatgctacctaccttttcatattgctaattgaagttattctttcttcccatagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttccatccctctcttcattcagcaaatcttcagtgagttcctttctaaatgtattgtatcagaacttgtgggggatataaagaaaaaaaagaggttatcacatggcttaggatgtttccaacccttggatcattttcaccccaggcccattagttacagagcactcagtcttacccagaagcatcggatatagtccaggcaaccggatccaagcgtgtgggaatcgcagtgtgctgcatgtgggaatctatcaggccaggatgattcaagcagcagcctgcagaagtgggatttggccagccttgcctgactctggccttccaacttgctcttatctacttccaaagtaaggaatgccccatgatgggccgagcagtccaaaaaaagtggcttggagttagctaccgcaattagcagtttctcattattcaacactgcattacctctttttcatattaactgcagaattttatttttatgtatttattatccttccaaaccca

SEQ ID NO: 444 - DNA, 1500 bp, Homo sapiens
tgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttccatccctctcttcattcagcaaatcttcagtgagttcctttctaaatgtattgtatcagaacttgtgggggatataaagaaaaaaaagaggttatcacatggcttaggatgtttccaacccttggatcattttcaccccaggcccattagttacagagcactcagtcttacccagaagcatcggatatagtccaggcaaccggatccaagcgtgtgggaatcgcagtgtgctgcatgtgggaatctatcaggccaggatgattcaagcagcagcctgcagaagtgggatttggccagccttgcctgactctggccttccaacttgctcttatctacttccaaagtaaggaatgccccatgatgggccgagcagtccaaaaaaagtggcttggagttagctaccgcaattagcagtttctcattattcaacactgcattacctctttttcatattaactgcagaattttatttttatgtatttattatccttccaaacccagtgttgtaggaagaatattacatataaatgataacttaggaatcttgtcaagtttttgtttcttcagcactaagtagcttattttctaggcaggtcttaattctaaatgtaacatgcttgaaaaaaacactattgaaaggatccgtctcttcagcatagtatttaatatacatatcaggcaatcaccatctcaagcatgattagactcaagtgctgccctccatcgtgtgagggatgctgggagactggaagcttagactttagctctttaagttggtgcaaaagcaattgcagtttttactattaataataataattgcctagccattgtgcagtaccttgcaagagctctttggcaaatgaaagaataattcaaagcaaagtaggccagatataaaacacttccaaatcacatttcaaaattgttctttcatgtcaactaggtgcatgtctgctaagggagtttttgcaaggacaggtggatagtgtgaggcctttac

SEQ ID NO: 445 - DNA, 5135 bp, Homo sapiens
acgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttaga

SEQ ID NO: 446 - DNA, 5158 bp, Homo sapiens
acgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttaga

SEQ ID NO: 447 - DNA, 1500 bp, Homo sapiens
agatgctaataaataaaagttcacttgtaattatatcaaatatagtaaccttataccacagatcttaccctctcccccaacatgcttttcctttcaataaaaactccctttatataaattttgagtttacagatccagatacaaaaaattatgtacaaaattttactggtatatttagtttaaaaagccaagcctaggcgcatctacccgacttacagttaagaaacaaaactgatgacttgatgatgatattcctgatattccatcaggaatgtcagggtatgtttcctaacttaaagggcatatcctattttgagagagatccgaactatgtcaactccttacaaacaactcagtgataggcggggctataaaccttactggtgaaggaggttcagatagattaaaacaacttgccctagatcaaggacccttcaatggaactgaaagggcagacgttctaattcaaaagttctacattatttttcgctgcactatacatcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttccccgccccctcactgcgtgcggtagccaatgagagccgaactggacttgaagcatctacgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcttaaaggtgttcctccgcagaccacgtgtttgtttatttaca

SEQ ID NO: 448 - DNA, 1084 bp, Homo sapiens
atcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttccccgccccctcactgcgtgcggtagccaatgagagccgaactggacttgaagcatctacgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcttaaaggtgttcctccgcagaccacgtgtttgtttatttacactcgctttaaacgcgggcccgttcccttttccaaactagccaggtcctttaaaaaaaatcgtggggtttgaataggaaatacag

SEQ ID NO: 449 - DNA, 1125 bp, Homo sapiens
tcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcccatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaa

SEQ ID NO: 450 - DNA, 1133 bp, Homo sapiens
actttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagctgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagact

SEQ ID NO: 451 - DNA, 1161 bp, Homo sapiens
atattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcgtatcctctgcctattttaaaaattgagatttttttgtttgtttttctacctgaattgcagaagttacttatatattctaattagtaaacctttgtgatacatatattttttcccaatcaat

SEQ ID NO: 452 - DNA, 1088 bp, Homo sapiens
tttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgctt

SEQ ID NO: 453 - DNA, 1142 bp, Homo sapiens
tataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagt

SEQ ID NO: 454 - DNA, 1115 bp, Homo sapiens
tactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctt

SEQ ID NO: 455 - DNA, 1186 bp, Homo sapiens
tttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataat

SEQ ID NO: 456 - DNA, 1172 bp, Homo sapiens
attaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtttgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcaca

SEQ ID NO: 457 - DNA, 1081 bp, Homo sapiens
gaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttat

SEQ ID NO: 458 - DNA, 1127 bp, Homo sapiens
tggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactc

SEQ ID NO: 459 - DNA, 1101 bp, Homo sapiens
tccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatt

SEQ ID NO: 460 - DNA, 1174 bp, Homo sapiens
tatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagttta

SEQ ID NO: 461 - DNA, 1063 bp, Homo sapiens
ttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactga

SEQ ID NO: 462 - DNA, 1220 bp, Homo sapiens
agtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaac

SEQ ID NO: 463 - DNA, 1084 bp, Homo sapiens
gctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttagtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaa

SEQ ID NO: 464 - DNA, 1059 bp, Homo sapiens
aatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtgtttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgg

SEQ ID NO: 465 - DNA, 1068 bp, Homo sapiens
aaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgat

SEQ ID NO: 466 - DNA, 1076 bp, Homo sapiens
agagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgc

SEQ ID NO: 467 - DNA, 3879 bp, Homo sapiens
ttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggtgcagtggctcatgcctttaatcccagcactttgggaggccgaggagggggttcacctgaggtcaggagtttgagaccagcctggccaacatggtgaaacctcgtctctactaaaaatacaaaagattagctgggcatggtggtgtgtgcctgtaatcttagctactcaggaggctgaggcaggagaatcgcttgaacccaggaggcagaggttgcagtgagccgagattgtgccattgcactgcagcctgggcaacaagagtgaaactcaatctcaaaaaaaaaaaaagtatctaaatgtaaaatatcttttttggaaatatagaatttaaaagcgactttcccccaaagaaatctgatgtcctttttgtatctgtcataaatttaattcatagtattttgggttttttttgttttttttttttgagacggagtctcgcactcttgcccaggctggagggcagggg

SEQ ID NO: 468 - DNA, 1500 bp, Homo sapiens
aggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaactgagtaaaaaagtatctcaatgggctgggtgcagtggctcatgcctttaatcccagcactttgggaggccgaggagggggttcacctgaggtcaggagtttgagaccagcctggccaacatggtgaaacctcgtctctactaaaaatacaaaagattagctgggcatggtggtgtgtgcctgtaatcttagctactcaggaggctgaggcaggagaatcgcttgaacccaggaggcagaggttgcagtgagccgagattgtgccattgcactgcagcctgggcaacaagagtgaaactcaatctcaaaaaaaaaaaaagtatctaaatgtaaaatatcttttttggaaatatagaatttaaaagcgactttcccccaaagaaatctgatgtcctttttgtatctgtcataaatttaattcatagtattttgggttttttttgttttttttttttgagacggagtctcgcactcttgcccaggctggagggcaggggcaccatttcggctcactgcaagctccacgccattctcctgcctcagcctcccaagtagctgggactacaggcgcccaccaccacgcctggctaatttttttttttttttttttgtatttttagtagagacagggtttttctgtgttagccaggatggtctcgatctcctgaccttgtgatccacccacctcagcctcccaaagtgctgggattacaggcctgagccaccacgcccagcctattttgtgtttttttaaagctaactaccattaagatcattatagaagtttggtataatgaagatttgggtttttcagtccaatgagtttccatattcttgaatgaaaaagatccacatttcatcatttgcctgtttcattttcttttagtacttttgaacttagtttggtcagaaaatactagaattttagtttgatctaaagaaccagcttatataacttgctgttgccatgtacatttgtatgtctttgctgtgtcaa

SEQ ID NO: 469 - DNA, 3145 bp, Homo sapiens
ggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 470 - DNA, 1500 bp, Homo sapiens
gtcaaacgtttgtctttttatttattttattttgtattttttgagacagggttttcaatctgtcgcccacgctggagtgcagtggcacaatttacggctcaccgcagcctcgacctcccgggctcaggtgatcctttcgcctcagccctgctaatatctgggatcacagacgtgggttttaccatgttgcccaggatggtgtcaatctcctgggctcaagtgatccgcccacctcggcctcccaaattgctgggattacaggcgtgagctaccgcgccctgccacaaacgcatatcttctaacgtaccatttcatttacttgctatattcattatctgaattttctcatattagaatgtaagcagaataaaggcagtgatttttctttttactggcgatcctcagagccaagaagagtctgggacatagcaggccatataaatgttttcgaatgagtgaatcatcaacgagtggatgaaacgataatgtggctaacaggcagcagtaaggaggctgtgtagaataaacccgtaatcccgatgttggcagtttgcttagaaagaaaaagggaggcagtcggagaggggcacacgttttaacaaaatactgggaggaggaggaaggctagttttttttttgttttcaagtttccttctgatgttactcccatgcttccgggcacattacgagctcagtgcctgccggaaatctcccacctggtggcaacctacccttgcatacaccccacccaggggcttcaagccttgcagctgagtaaacacagaaaggagctctactaaggatgcgcgtctgcgggtttccgcgcgacctaggcgcaggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatct

SEQ ID NO: 471 - DNA, 1279 bp, Homo sapiens
agcagtaaggaggctgtgtagaataaacccgtaatcccgatgttggcagtttgcttagaaagaaaaagggaggcagtcggagaggggcacacgttttaacaaaatactgggaggaggaggaaggctagttttttttttgttttcaagtttccttctgatgttactcccatgcttccgggcacattacgagctcagtgcctgccggaaatctcccacctggtggcaacctacccttgcatacaccccacccaggggcttcaagccttgcagctgagtaaacacagaaaggagctctactaaggatgcgcgtctgcgggtttccgcgcgacctaggcgcaggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagca

SEQ ID NO: 472 - DNA, 1155 bp, Homo sapiens
tttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattaga

SEQ ID NO: 473 - DNA, 1279 bp, Homo sapiens
cctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaat

SEQ ID NO: 474 - DNA, 1147 bp, Homo sapiens
aagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttc

SEQ ID NO: 475 - DNA, 1150 bp, Homo sapiens
gttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagt

SEQ ID NO: 476 - DNA, 1134 bp, Homo sapiens
cgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaatta

SEQ ID NO: 477 - DNA, 1200 bp, Homo sapiens
cttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaa

SEQ ID NO: 478 - DNA, 1110 bp, Homo sapiens
gggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgcctta

SEQ ID NO: 479 - DNA, 1124 bp, Homo sapiens
attactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagtt

SEQ ID NO: 480 - DNA, 1151 bp, Homo sapiens
aacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcg

SEQ ID NO: 481 - DNA, 1098 bp, Homo sapiens
tgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatat

SEQ ID NO: 482 - DNA, 1246 bp, Homo sapiens
ctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaag

SEQ ID NO: 483 - DNA, 1205 bp, Homo sapiens
aattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcact

SEQ ID NO: 484 - DNA, 1248 bp, Homo sapiens
tgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccacc

SEQ ID NO: 485 - DNA, 1176 bp, Homo sapiens
ccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgt

SEQ ID NO: 486 - DNA, 1443 bp, Homo sapiens
gtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactccatgtcatatataaaaacctccactttgggaggcgaagca

SEQ ID NO: 487 - DNA, 1500 bp, Homo sapiens
acatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactccatgtcatatataaaaacctccactttgggaggcgaagcaggcaatcacttgaactcaggagatcaagaccagcctggacaacatgacgaaaccccatctctacaaaaataaatgcaaaaattagccgggcatagtggtgcttgcctgtagtcccagctactcaggaggctgaggtgggaggatcacgtgatctgggagaggttgaggttacagtgagctgcactccatcctgggtaatacagtgataactgtgtctcaaacaaaacaaaacaaatcaccttcagtgatttttagaccaaatgtacaaggtaatactctcaaggttttaatgttttatagttctgcagaagataacataggaaaatatttttatgtccttggctttgggaagaatttaagtcacagaaaaacaccatccataaagtttgacttatttagctatttgaaattaacaacttctattaaaaggcaccacaagtgaaaagacatgaatcgtaatggaagaacatactggtacgttataaaatatcaaagagttg

SEQ ID NO: 488 - DNA, 4435 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 489 - DNA, 1500 bp, Homo sapiens
ttgtcgcccaggctggagtgcagtggcgcgaccttggctcactgcaaacgctgcctcccaggttcaagttattctcctgcctcagcctcccaagtagctgggattacaggcgcatgccaccacgcccggctaatttttggatttttagtagagacgggggtttcaccatgttgactaggctggtcttcaacgcctgacctcaggtgatccgcccgcctcggcatcccaaagtgctgggattacaggcgtgagccactgcgcccggcctctcatagtctcttagctttctaaaatttgaaaaatcctgtaaagacacacctgggtcaaagggctcagataacggactgtggcccttaagtacttacgtcacaggttattgagaggatcgatttagttaccagatgtaaaatgctgggatcagtgcctggcaaaggaaaactttgtacagctgcaggctttcaccatacacaacagcatcgctaacgaatgctattacaatattcatttagcgtttaccaagtgcctactctatacaaatcttgagaatacaacgtgaaggtgaactgctgactaaagtttggtccctttcgctccgtctccttgcgaaaatgctctaacggcaggaggtcacgcgagcgctggacgcgtttctccccgcgagcccctttccgaggcctttcgggtccccccggttatccccgcccgggcggtgcgcgcccccgctgttcccgcttccgctccagagaggcagggctttccgagcctgctagccccgcggccgcaactaaccccgggtcggagtgttccggcccggccagccccgcggcgtgagggaaggggagctcagcagttccccgcgcggggcccaggcgtcggcggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttggg

SEQ ID NO: 490 - DNA, 1412 bp, Homo sapiens
ttcatttagcgtttaccaagtgcctactctatacaaatcttgagaatacaacgtgaaggtgaactgctgactaaagtttggtccctttcgctccgtctccttgcgaaaatgctctaacggcaggaggtcacgcgagcgctggacgcgtttctccccgcgagcccctttccgaggcctttcgggtccccccggttatccccgcccgggcggtgcgcgcccccgctgttcccgcttccgctccagagaggcagggctttccgagcctgctagccccgcggccgcaactaaccccgggtcggagtgttccggcccggccagccccgcggcgtgagggaaggggagctcagcagttccccgcgcggggcccaggcgtcggcggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggc

SEQ ID NO: 491 - DNA, 1197 bp, Homo sapiens
gcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcc

SEQ ID NO: 492 - DNA, 1170 bp, Homo sapiens
gtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattct

SEQ ID NO: 493 - DNA, 3545 bp, Homo sapiens
ttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgaccc

SEQ ID NO: 494 - DNA, 1266 bp, Homo sapiens
gttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctca

SEQ ID NO: 495 - DNA, 1118 bp, Homo sapiens
ctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtg

SEQ ID NO: 496 - DNA, 1090 bp, Homo sapiens
aatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaag

SEQ ID NO: 497 - DNA, 1155 bp, Homo sapiens
ttaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattat

SEQ ID NO: 498 - DNA, 1200 bp, Homo sapiens
gggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgta

SEQ ID NO: 499 - DNA, 1175 bp, Homo sapiens
gtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaa

SEQ ID NO: 500 - DNA, 1500 bp, Homo sapiens
atgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgcca

SEQ ID NO: 501 - DNA, 1936 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 502 - DNA, 1905 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaaaa

SEQ ID NO: 503 - DNA, 1945 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 504 - DNA, 1710 bp, Homo sapiens
tctcgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 505 - DNA, 1794 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 506 - DNA, 1791 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 507 - DNA, 1500 bp, Homo sapiens
tggggttgggtatgggggttgctgtggctaggagttagccttatgaaggacccaaaccacccaggtctgtgacccccccactccacagttgagggctggcactaaagagaaaagggcttatacttactggttcagcaaactcttcctgtccccaagcccactcagctcctgtgggtaggtaaagggagagttgtgacaggcctctagcaccagccccttcacaaccacctgccctccttgtttcccaactctcaccgtgtccacagccacgaaattagctgtctttatggctagcaggagggatggccacatctccttgaagttgttgctttgcacatccactacgggaacctggactactagctcctccccagatgttgtgcttttgctgacaccacctgggggttaggagggtgatggatgttcatgcttaaggaaagagcccaggggaacagacaccaagctaggccacggtgatggtggtaaggggggtagtttccattggtagcttttcccacaagcctttgtaacccacgtgttctacacacaggccttggagtggagaatgccctgaatttggggagaggaagcctgagtcttctactggcttgtatgagcctgggtaaattacttcccacctcgctttcacaatctgtagaggagaaagttggactagacgacctttgattcttttttcccatgtcctgcaggaaacattttgtagggcttgaggatctcagctcccttaatatcccacagggatccatactactgttctcatggtgccccagcgccacaagcaacagctcccagtaagccccagagcctggcagtgccccacaccagagctcccaatacgtcctaccttcctttggatcacaacgctcaatccactccactgaactgaatcacaactattactactaaccgttatgagctccagactacatctcccgccatgcctccatcagccccatgctcccaacgctccaggcttttgcagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggtacgctggacttgcggtccgtctcctggcgcggttcaggcagtcggggatggggcggggtctcgccgtcgggtcgccgatgggtcgaacttccgttcagacgtcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggtaat

SEQ ID NO: 508 - DNA, 1252 bp, Homo sapiens
attggtagcttttcccacaagcctttgtaacccacgtgttctacacacaggccttggagtggagaatgccctgaatttggggagaggaagcctgagtcttctactggcttgtatgagcctgggtaaattacttcccacctcgctttcacaatctgtagaggagaaagttggactagacgacctttgattcttttttcccatgtcctgcaggaaacattttgtagggcttgaggatctcagctcccttaatatcccacagggatccatactactgttctcatggtgccccagcgccacaagcaacagctcccagtaagccccagagcctggcagtgccccacaccagagctcccaatacgtcctaccttcctttggatcacaacgctcaatccactccactgaactgaatcacaactattactactaaccgttatgagctccagactacatctcccgccatgcctccatcagccccatgctcccaacgctccaggcttttgcagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggtacgctggacttgcggtccgtctcctggcgcggttcaggcagtcggggatggggcggggtctcgccgtcgggtcgccgatgggtcgaacttccgttcagacgtcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggtaatctttctctcctgctctcgcggcgggaacgcggggcctccgtgttctgctgtcttcatcagcgtgggccgcgggtagcgggtagtggggtggctgggtttgggctttccagagaaggtgacgctgcctgagctgagcttaaagcacgcccaggagttagactaggagagggtcgtgtgggggaaagaagggcgttctgggcatcggtaaattcccagagaggatggagagctcagtgatctccagaaagtgaa

SEQ ID NO: 509 - DNA, 1121 bp, Homo sapiens
tctcagacagatcttttgtccctctgatccttggtttcttctaggataaaatgaaggttttggacttaatgactactacaggctgtttcagtgtaaccatgctacatctctaagaggcagagaaaccgcctacccccattctcccagacacacctaaacaacccctatccacacacacagtcacagtaagcatcagagatacacaaatgctcccaaacaggaggctttcatccttgacccatcccagccctggcctcacagtctttgcatgtctccagggctgtaacgccggcccccttgaggccacttgctcagctatactagttgtatctcagtgctgcagccagccaagagtaaacccgtgagcatcttgagagtgcttgagagaagctggaccccatgtgaatggtggatgagagggagatagctatcacccttggaaggcctcaaaatttggcctcattgtgactgactgctttggctgggtctttttgtttcaggccatcatgaggaagccacgagcagccgtgggaagtggtcacaggaagcaggcagccagccaggaagggaggcagaagcatgctaagaacaacagtcaggccaagccttctgcctgtgatggtaaggaactaggttgtggcccaaggctcattggccatgaaaggcagattcaggctgggaagggattgtgatacgtatcaagacattaagagacttactaagggccaggtgcggtggctcacacctgtaatcccagcactttgggaggccgaggcaggtggatcccttgagcccaggagtttgagaccagcttgggtaacatggcgaaatcccctctctatgctcgcgtggtggtgagcgtctgtagtcccagctactcgggaagctgaggtgacaggatcgcttgagcctggaaggcagaagttgcactgagtcaagataatgcaactgcatttcagtctgggcaacagagccagactcttgtctcaaaacaaaagagactcactgagggtgtaattctgactgtattgctgtgtgacattgggacaattgctctgaatggctgctttcttaccagtaaaatggagcagtagttcagcatttcctccctcatgtggctt

SEQ ID NO: 510 - DNA, 1191 bp, Homo sapiens
gcctggaaggcagaagttgcactgagtcaagataatgcaactgcatttcagtctgggcaacagagccagactcttgtctcaaaacaaaagagactcactgagggtgtaattctgactgtattgctgtgtgacattgggacaattgctctgaatggctgctttcttaccagtaaaatggagcagtagttcagcatttcctccctcatgtggctttcatgggaccaaatgagtttatgagcctgaaagtgttttgtgaataggaaggtcctgcaccagtatacattctagctggctaaaactattaggttttcattatggctcagagacaagccagtagtaccaccctgagaaaattaaggccagaaacttagccacagctacacacaattacataactctggtctgactccagctccaaagcttaagggggttagttgggggaagccctaagtgggagcatactgccacaggctgctgtgtcccaagaccctgatgcacagcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggtaggcaggcgaggagcagggacagtgggtgggaggcaggcacccagccccctccaccctaactcctcatctggggttgcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgag

SEQ ID NO: 511 - DNA, 1040 bp, Homo sapiens
acattctagctggctaaaactattaggttttcattatggctcagagacaagccagtagtaccaccctgagaaaattaaggccagaaacttagccacagctacacacaattacataactctggtctgactccagctccaaagcttaagggggttagttgggggaagccctaagtgggagcatactgccacaggctgctgtgtcccaagaccctgatgcacagcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggtaggcaggcgaggagcagggacagtgggtgggaggcaggcacccagccccctccaccctaactcctcatctggggttgcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcg

SEQ ID NO: 512 - DNA, 1074 bp, Homo sapiens
gttgggggaagccctaagtgggagcatactgccacaggctgctgtgtcccaagaccctgatgcacagcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggtaggcaggcgaggagcagggacagtgggtgggaggcaggcacccagccccctccaccctaactcctcatctggggttgcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggcca

SEQ ID NO: 513 - DNA, 1042 bp, Homo sapiens
taagctggtacgaccaagagaaacgggacctaccatggagaagacgggtaggcaggcgaggagcagggacagtgggtgggaggcaggcacccagccccctccaccctaactcctcatctggggttgcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccag

SEQ ID NO: 514 - DNA, 1072 bp, Homo sapiens
gcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaa

SEQ ID NO: 515 - DNA, 1114 bp, Homo sapiens
caacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaac

SEQ ID NO: 516 - DNA, 1098 bp, Homo sapiens
tgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaag

SEQ ID NO: 517 - DNA, 1145 bp, Homo sapiens
ctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaa

SEQ ID NO: 518 - DNA, 1064 bp, Homo sapiens
cgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtacctggatactgggcgtggagggcagtggcatgagtaacaagagagaatggagggaatcggcagctgaggcctgacccctgcctggctgccctccctctcaggtctgctggcaggactgtgggagttcccgtccgt

SEQ ID NO: 519 - DNA, 1189 bp, Homo sapiens
aaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtacctggatactgggcgtggagggcagtggcatgagtaacaagagagaatggagggaatcggcagctgaggcctgacccctgcctggctgccctccctctcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggtaagtgagcagcggaatagccaaggatgttggcttttgaggctatatccacaggcctatttgaaccccttgacccttcctccaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggcactacctttgttgtctttg

SEQ ID NO: 520 - DNA, 1137 bp, Homo sapiens
agcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtacctggatactgggcgtggagggcagtggcatgagtaacaagagagaatggagggaatcggcagctgaggcctgacccctgcctggctgccctccctctcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggtaagtgagcagcggaatagccaaggatgttggcttttgaggctatatccacaggcctatttgaaccccttgacccttcctccaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggcactacctttgttgtctttgttgtacttccttgtgtttcctacatgttctacatgaatatattactgtgtaaacaggaaaaaaagcatttttttttgagacggagaatcgctctgttgcccaggctggagtgcaatggcgctatctcggttgactgcaacctccatctcccgggttcaagtgattctcctgcctcagcttcctgagtagctcggattacaggcgcccgccaccatgcctggctaatttttgtatttttagt

SEQ ID NO: 521 - DNA, 1153 bp, Homo sapiens
agtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtacctggatactgggcgtggagggcagtggcatgagtaacaagagagaatggagggaatcggcagctgaggcctgacccctgcctggctgccctccctctcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggtaagtgagcagcggaatagccaaggatgttggcttttgaggctatatccacaggcctatttgaaccccttgacccttcctccaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggcactacctttgttgtctttgttgtacttccttgtgtttcctacatgttctacatgaatatattactgtgtaaacaggaaaaaaagcatttttttttgagacggagaatcgctctgttgcccaggctggagtgcaatggcgctatctcggttgactgcaacctccatctcccgggttcaagtgattctcctgcctcagcttcctgagtagctcggattacaggcgcccgccaccatgcctggctaatttttgtatttttagtagagatgaggtttcaccatgctggccaggctggtctccaactcttgacctcaagtgatccgcccgcctcagcctcccagaatgctgggattacaggtgtgagctaccacacccagccatgattttttgtatttttagagatggggtttcaccatgttggccaggctggtctcaaactcctggcctcaagtgatccacccgacttggcctcccaaaatgctgggattataggcgtgagc

SEQ ID NO: 522 - DNA, 1042 bp, Homo sapiens
gctggagtgcaatggcgctatctcggttgactgcaacctccatctcccgggttcaagtgattctcctgcctcagcttcctgagtagctcggattacaggcgcccgccaccatgcctggctaatttttgtatttttagtagagatgaggtttcaccatgctggccaggctggtctccaactcttgacctcaagtgatccgcccgcctcagcctcccagaatgctgggattacaggtgtgagctaccacacccagccatgattttttgtatttttagagatggggtttcaccatgttggccaggctggtctcaaactcctggcctcaagtgatccacccgacttggcctcccaaaatgctgggattataggcgtgagccaccatgcctggccaaaaaagcatattttaaacaaaagtactgggacatgaagttaagggcagaacaccggtttatctcttttgcaaaaagtgccagccctcacctccctgtcttcttgtctaggttttccgtgtgtatcagggccaacagccagggacctgtatggtaagtctcctaggcctctcccaaccgtgtctccccaggcctgagtccataggtttttagtcagttaactaacgaatgtctgggtgaacattctccactccaggcttcactggagggaggaatagttcttgacctggagaccttccattgtggggtgcagggtagagggaaaggaaaaaaatgatgaggactctccagtgtcacaggtgtgtgaaatgcctgtactgagttttgtgggatatgaattgtggagccatcagttcttttttttttttttttttttttttgagacagtctcactgtcacccaagctagagtgcagtggcccgatctcggctcactgcaatctcccacaactggattaaagcgattctcctgcctcagtctcccaagtagctgggattacaggtgcctgctaccacacccaactaatttttgtatttttagtagagacagggtttcaccatgttgactaggctggtctcgaactcctgacctca

SEQ ID NO: 523 - DNA, 1196 bp, Homo sapiens
gttctaattgggagacggatcaggaaaggctgtttggaggaagcagctggtaatcttcgtcctagaaatgaatccttttcttcaggtttgggaggggaatcaaccgtagcgatgttctttccagtcccaagagtagtgtgagcaaaggtggagcccagtgcaggctgcagtgctcaaggagctgtgagcagttggtttagctggaaaggtcagcagggcctgctgggtcagtcagggtgtgagccctaggctgctgactcattttaggtggaggagagaggagtcagatttgcatttttaggacaattcgattccctcaggcagccttttggagggttgattgatggggcagatacttgaggcaggatgaaagctctacagcattccaggctaagcctagctagatcagtagagtcggggaaagggagagaggacaaggagaggattctctgctccccctcccccaactacaaggcctccctccttccattttttcacagggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttattttatgttgtatttttttgagatgggggtctcgctatgttgctcagactggtttcgaactcaggtgattctggcctcaagtgattctcccacttcagcctcctaaagtgcttggattacaggcatgagccaccacgcccgcccttttgtagctattttggacagccttccaccctctccctagccccctcaccccttatatctgagggagggacccagaaaagtggtgacgttctgcttggttctgactttctctggctgaactcccagccagccccgggcagatggggttggagtgggggtgttctgtccagactgatctgccctccaacccccaggagaaaggcaaggcagctacagggagaacctgccagtggctgacacacaacaccctctgtttacgtctcaggtcagctctaattggagtggtggcatcactctggagtaggtagttgggctcaactctcacccagcccctccccacctgagtggtcgctccc

SEQ ID NO: 524 - DNA, 1500 bp, Homo sapiens
ttagctggaaaggtcagcagggcctgctgggtcagtcagggtgtgagccctaggctgctgactcattttaggtggaggagagaggagtcagatttgcatttttaggacaattcgattccctcaggcagccttttggagggttgattgatggggcagatacttgaggcaggatgaaagctctacagcattccaggctaagcctagctagatcagtagagtcggggaaagggagagaggacaaggagaggattctctgctccccctcccccaactacaaggcctccctccttccattttttcacagggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttattttatgttgtatttttttgagatgggggtctcgctatgttgctcagactggtttcgaactcaggtgattctggcctcaagtgattctcccacttcagcctcctaaagtgcttggattacaggcatgagccaccacgcccgcccttttgtagctattttggacagccttccaccctctccctagccccctcaccccttatatctgagggagggacccagaaaagtggtgacgttctgcttggttctgactttctctggctgaactcccagccagccccgggcagatggggttggagtgggggtgttctgtccagactgatctgccctccaacccccaggagaaaggcaaggcagctacagggagaacctgccagtggctgacacacaacaccctctgtttacgtctcaggtcagctctaattggagtggtggcatcactctggagtaggtagttgggctcaactctcacccagcccctccccacctgagtggtcgctccctagggggagaggaagcacaggagaagatttgttctgttttaaattcctacctcaaatacgaaataatttatttagggttatgttacatacggagtgaaacaatacagaaaagcaaagggctaataatgacaggatttgaggagtgggtgggaggaaatagaatcacagcgggacacagggaggactcgaaagtattggttatgttctatttcctagtgtgtaattcttttattgttctttgtatcttacatatttattatagactgtatataagaaatgttttagttttaaaaaatcccacctctttggagcccaatgagagacacagcttctggcaggcactgatgaaatggaagtcacacctgccccccggaggcaaagcctttcactagttgggcctcctgcagatgttcctcagttctgtgctggtctccccagagctgcaggacagctggctgcacccagccctgggcatccttaggcttcctggctcctggcag

SEQ ID NO: 525 - DNA, 4622 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtta

SEQ ID NO: 526 - DNA, 1500 bp, Homo sapiens
gtaaaccagcctttttttttttttttttttgagacagggtcttgctctatcgcccaggctagagtgcagtggcatgatcatggctcactgcagcatcgaactcctgggctcaagtgatccttctgcctcagcctcctgagtagctgggaatacaggagcatggcaccaagccctgctaactttaaaattttttataaagacagggtcttgccatgttgcccatgctgatcttgaactcctggcctcaagtgatcctcccatcttggcctcccagactgctgggattaaaggagcgagccatggtgctgggcctaaacaagcctttttaaagtgacttttcccccctattacagaatgcttttgaaagccaaaatgtatgtgatcaggagtgtgctctcagatgtttatttagtagtgcgcaggatgtagactacattatgtgggacgtgggtggtgatgggttgggaagctactggaattaggaggagagcttgaaccagcttgagacaggtggaagtggaaaggaagggtattaaatacaggagactgcccagtatttagcatgtgattagctgaaagtgtggcattatgaaataaagacgttaagacaagttgatttgaacttagaaaagagtaaaaataatgagtttacttcgaggtgaaatccttatcttcatcattattatcaccattactagattccaaaggaatacctgcaatttaagaaactgcaaacgcacgaaactacataactggtaagtattttaatgcatttaattaaaaattttccttatgttgctttggagttagtttttaaaattcttttcgttcataatcaggaaaggtagtaaccttacattcagcgacaccttagaaacatacccttttaacgcagcacatttcaatacagattgtgctgttccttttccaaccaccaggtggcgggcaagcgcccaagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggtaagggcagaagggaagcctcggggcctattttcccggtagcgactgcctcgggggagggcctgcgggtgattcctgcgtcgcgtccgttcctgcccggggacgctgcggaagcggtcgcagaagcggcgagtacgctgtatggcaagcgcatattcttcccgggcagcacggcggctgtgagctggaattcagcgcgggcggtggggtgattgcggcgccccctggtggcagtcctccgcgcccctcccctgactccccctccctcccagcctcacccccgcgccgttgcagcgctagggctggatggcctgcgggtaagcggcagcaggcgcctagtgggaacccccggc

SEQ ID NO: 527 - DNA, 1147 bp, Homo sapiens
cttgagacaggtggaagtggaaaggaagggtattaaatacaggagactgcccagtatttagcatgtgattagctgaaagtgtggcattatgaaataaagacgttaagacaagttgatttgaacttagaaaagagtaaaaataatgagtttacttcgaggtgaaatccttatcttcatcattattatcaccattactagattccaaaggaatacctgcaatttaagaaactgcaaacgcacgaaactacataactggtaagtattttaatgcatttaattaaaaattttccttatgttgctttggagttagtttttaaaattcttttcgttcataatcaggaaaggtagtaaccttacattcagcgacaccttagaaacatacccttttaacgcagcacatttcaatacagattgtgctgttccttttccaaccaccaggtggcgggcaagcgcccaagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggtaagggcagaagggaagcctcggggcctattttcccggtagcgactgcctcgggggagggcctgcgggtgattcctgcgtcgcgtccgttcctgcccggggacgctgcggaagcggtcgcagaagcggcgagtacgctgtatggcaagcgcatattcttcccgggcagcacggcggctgtgagctggaattcagcgcgggcggtggggtgattgcggcgccccctggtggcagtcctccgcgcccctcccctgactccccctccctcccagcctcacccccgcgccgttgcagcgctagggctggatggcctgcgggtaagcggcagcaggcgcctagtgggaacccccggcaggaagttagcatgggcggaccacacgggggccacacatgacttgtgaagaactactggacagtttggggaaatgactaccacgaaaaggcttactttcagttttgtttcagactccttttccacaatgtcatcagaacaatgggaa

SEQ ID NO: 528 - DNA, 1134 bp, Homo sapiens
ggttcaagcagttctcttgcttcagcctcccaagtagctgggattacaggcttgagcatctttttttatagtttcctgatatttttgtttatcaagttccaaacataatattgtgattgttgctaggtaatacattaagtttttaagttaatttgagggaacattgactcctttcagcattgctttccctttagaaaaatgatgtagccttctatctgtttagataacctttttttctttttctcttttttattgtattttaaattttgttgttgttactcctgaaacaccatagttagataacctttgatagccttcagtgaggctttactgaaaacacaagtttgacatatgtaaagttgactaacatttgaataacaaaggtgttttatttaatatttgtcatacctatatcatatacacttacatgtatgtgtgtgttcgtgtacatgtgtatgtgtctatcaacttatctttttttaaaaaaaaatttatctcaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatgttactaattttatttcactagtttccagtaagggggttgaaatcacaaaatattctcttggtttgtatgtgagagagagttcacaggatttgtcattttatagagctgtgtagacttttttaatgttaacaaaattaaatacttatattgtggcagtggtaccagtggtatttgttcattttgagatttgaagtttctatttcagtaatttactctttgttttagttagaaactcagaggaagtaggacatagttatttttatttgcttactaaacatttattgtttactattagtttggtgcaaaagtaattgctgtttttgccattagcagtaatgtgtttttatgtgtcagtaactgtgccaaccctgcgaatagaacaatgaacagaccttcatgactctggctcttaaagaggttatgtagctgtgtggaaacgggcatttctcatataatacaagtttttgcaatgggaattgatttgttttattaggg

SEQ ID NO: 529 - DNA, 1149 bp, Homo sapiens
gttttgtttctgttcttttaggtatagaaaaacattttggaaatttctacagaaaaagtaaaattgttactgtaagtcagaaacactagcctataacctcgtattctcatgggactaatttttacaatgtggttttgatactgtaaaacaaacaaaaaaagatctaggaatgaaattgtcatgttttaaatgaaacagactgcaccaaagcaaaaaattctcaaatgtgtgtgaggggtcaggagaatccccactgacttacacaaataaagaacatgtgtgttctaggaggggtattcctgggttaagaaacttccctaaggggaaatatgaattgttagttgagtgatcttcctctcaaggcaaccgaagcagtaattgttgtctgccgtgttgggaggttagccacctgcctattgtcttttcttttgaaaactttttctctgagaagtgaatgtactgagtggtaaaagactttaaattatttgctaacttttcagagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcaggtaagacattttaaaattgattttaaaatggacagctttgtttcagccaaatcctaaaggaaaatgatatttctgattaatgaatttaaaacagtataatttagttcctgcttagcacagtattggactctgtgccatgggtggtgagtgcattttgtacatcacggtgatgagagtttgagtgggccctgagggacttcatgggaagttacatttcttcgattcctcattggtgaaggtataatgttaacttttggtcattgttttttcttcatttggactcaagacttaggatttgataattttctaggttacaaagcttaatgatgaggaactgataatttcataggttacaaagggtaacaataaataaaagttacaataacagtatatgatgtgagcttaaagttttaaagtactaaaaattgccatctctgcaactctgatactatgactttatttaacttattctcatttacagaatagagtatgagcctttg

SEQ ID NO: 530 - DNA, 1160 bp, Homo sapiens
tgtttggaagtaaattcaggtaagacattttaaaattgattttaaaatggacagctttgtttcagccaaatcctaaaggaaaatgatatttctgattaatgaatttaaaacagtataatttagttcctgcttagcacagtattggactctgtgccatgggtggtgagtgcattttgtacatcacggtgatgagagtttgagtgggccctgagggacttcatgggaagttacatttcttcgattcctcattggtgaaggtataatgttaacttttggtcattgttttttcttcatttggactcaagacttaggatttgataattttctaggttacaaagcttaatgatgaggaactgataatttcataggttacaaagggtaacaataaataaaagttacaataacagtatatgatgtgagcttaaagttttaaagtactaaaaattgccatctctgcaactctgatactatgactttatttaacttattctcatttacagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaagtaggttgaatgtcttgttcttatgttaaaaataagttatttgaatttaagcttacccactatacacagatttttttttaattactttaaaactatcagaactgttagttgtagatttatatatacccactccatccctttgtataccatttaggcttgagtggcttttcatataacctgtttattatctgagacaagccaaaagcaactaaaattatatttcagattttgtttagcattttaaaaagcgattctgttgtccttccaccgagaaggttatgacagtgcatactttgtgttttcagtcttaaagcaacgcaactagagattaactgccagtcttcaaagtttgcatctcatgtctttctatcaagttgtctttctccaatctccaggtgattcatctccttttaaacaggttgacctatagatttgtgggatccttttaggttaatatctatagtaaaaagccacaaatacttagattcctttattaaaaa

SEQ ID NO: 531 - DNA, 1104 bp, Homo sapiens
ttaccaaaaattattttatttactttctcaaaaaggctttattgcatagttacaatctttttgaaagacaattagtctaaaaatagctcatgttcatctcctaatattgtcttccctgaagcagatatgttacatttcctcaattctgaaatatatttttaacattttaatgtcttcgaaagtggaatgcattttaaaattgaattttattttatgttgttccaccctttccaaaaaagcagttttaaaaattagtattataatcggtgacttcttataattgagtgattatactgtgatttatgttctaaaataatgcagtgaccaaagaccgacttctattttatagattgtggcttctttataaatttagagagatgaaagggaaaacattattttttatggatgtaaacagcctctttgtagtttataacttaaaacttttctttaaaaaatgctagcatgtgaatatatatattcacatgttttcttcattgtagacaatatgtgcactcatttgtggacgtccaattgtaaagccagaatattttactgaattcctgaaagcagttgagtccaagaagcagcctccacaaattgaaaggtatattatgtattttaaatataacaagatgtcacttatatgatagcattgatttttatttaagttaattccctctttaatgcttgtttcaggatgtaatagttgctgtgttatagttcggtattattaatggaaggttttttgttagtttgtaaagaaagagttccccaaatttctttgttggttattctgtatctctgaaacaaatgttaaatatgtgctaatatttaaagaaaaaaatggaaagacagtaaatggcactgaggtaacctcatggtcagaagagcacatatgtcagttccaggcatcacgccacagttagctctggaattgtgtggtgcagcagccctctttgcaagccacatagtccagaatattaacagcaccatagctttgggaatggagcttagtttttctgagctccagttactcattgcaaaattgagagtaatacctacctagctgagttaaaaagtcaggaaacaacagatgctggcgag

SEQ ID NO: 532 - DNA, 1118 bp, Homo sapiens
tgaactgagtaaataatgtaagtttaaaaatttcctgaacttctccaaagagatctctaacaaaacactcataatagattgtgctagtagaattgaaacatgagcgttttaatagatattggctcctaagtaaacacaagatgctaatagaatttgatctttatggatgatgtttctctcaaacttttgtaattcagacaccttgtttgagtcatgtgtgtttaatgttcatcctgttatgattgtctaccttggattatttattttgagatattaatgatcaattctagctcttctttgtgtcacctgccaccatatttctagaaaacgcgattagatgctttttgtcattttgtcccagataaaattcttacttaaaaaaaatactataaaggtattatggaaattatgccttttgagtgtcagatagtcactccgtttacaatttaatagcaaacatagtagtatataattagaatatactttaattatttttacagtttttacccacctcttgatgaaccatctattggaagtaaaaatgttgatctgtcaggacggcaggaaagaaaacaaatcttcaaagggaaaacatttatatttttgaatgccaaacaggtaattatgttataagctaaattttcctaaagaatacattacaaactaggatacattattaactcttatcagtagttgttaacgtatttcattttgggattttgtgtaaaagtgtgaagtagaataaaaaaaccccaggcaccagacctgcccagtgatcatggctgtgattacggggtttcttaaaatctgtgataactggcctattcataaatatgcaagtgagaaggacaggaaacttagttttaacttctttagttagtaagctaaacctctttagttagtaagctcactaaagaagttaaatcagttgaatatgttctgtgtaccaaagtggggtttccaagagtttatgttgtagtggagaaatgcagataagcccacagttagagtgctgttaggaagtgtgatgaggaaccacagagagtgtaacagttccagggccgcagagacctgttgaactagggactttctcaaagtggaagctgaaatgacctact

SEQ ID NO: 533 - DNA, 1194 bp, Homo sapiens
gaagtagaataaaaaaaccccaggcaccagacctgcccagtgatcatggctgtgattacggggtttcttaaaatctgtgataactggcctattcataaatatgcaagtgagaaggacaggaaacttagttttaacttctttagttagtaagctaaacctctttagttagtaagctcactaaagaagttaaatcagttgaatatgttctgtgtaccaaagtggggtttccaagagtttatgttgtagtggagaaatgcagataagcccacagttagagtgctgttaggaagtgtgatgaggaaccacagagagtgtaacagttccagggccgcagagacctgttgaactagggactttctcaaagtggaagctgaaatgacctactcaagaagtagcaccaagtcttcttgaattgtacttctatgtttcccaaatcaaattcttatgtgttcaaaaaattactacattttactttaaaaaatgtttccttccatttttagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggtatagaattattctttattagtaaaaaactgcaagtaggagattttatgtttaaccttttttgttgcttttcacctaacaatgtaaaagtagatacaagaattttttttttttgagacggagtcttgctcttgttgcccaggctggagtgcagtggcacgatctcggctcactgcaacttctgccttctgggttcaagcaattctcctgccttagtctcctgagtagctgcgattataggcacccaccaccacacccagctaatttttgtacttttagtagagacagggttttgccatgtaggccaggctggtcttgaactcctgacctcaggtgatcctcctgcctcagtctcccaaagtgctgggattacaggtatgagccaccgtgcctggcctattttttatttttttgagacagggtcttgctctgttgtccaggctggagtgcagtggcacaatcttagctcactgcaacctctgccttctgggttcaaacga

SEQ ID NO: 534 - DNA, 1098 bp, Homo sapiens
tgagtagctaggattacaagcgtgcaccactacacccagctaatttttgtatttttagtagagatgaggttttaccatgttggccaggctggtctcaaactcctgacctcaagtgatccacccgcctcagcctcccaaagtgctgggattacaggcatgaaccaccatgcctggccataaaagcctgttctgttgtttaatttgggtagtactgtattctttttattccaaaaattgtagaattttagaactgggaagatctatattctttagccccttattttacagatgaagttaatggagttactaaaagatggtagacttgtcaacgtaacagtgccccagcgagtaagctattatagtactctgcatttgaaattctgtctataccataaaattatttgggaggaaaaaaaagaggttgctttatcttgacattatctgaataaaagttgctagttttaatatattatcatacttaaactattttattctaataggcaaggtcttagacctattcctgaagcagaaattggattggcggtgattttcatgactacaaagaattactgtgatcctcagggccatcccagtacaggtaattgaagcattattttattgattcgttagcaactttattatgtaaatcgataagctaaatatacgttactcatatacttgctaggggtgaccatattcaccatgttttaaaattcatccatttatactttcatttattcattccataaatatttgtggctgccatgtagcagaaactgttatgaagtggtaaataaaataagaaagatccttgttattataaactttatgttctgaagatcaagatttagtaaccaaacacacacacatggtaagttcagatcaagccaagtataaagacaggtaaaacaaggtgatgtatgtaatagtgatggtagtaggctatttagataggtattcaaggaaagtctcaggaggtgacatttgagccatgtgtcctgaatgatgggaaaaggcagctgtgtgaggatctgggtggtggataattccaggtagaaggaacagatcactcttaggtttgtgtggagaattctaagg

SEQ ID NO: 535 - DNA, 1130 bp, Homo sapiens
ttcttctggtaagtaaaaagatgaggtaatcattatggttttctggagtagccagaagtttatgtctaagatggttttacatgatttgtttcaaataatgtattccttatgaaaataaaactcactaattctgatttctatagatggtagggtgtatacactttctgtgggggaataaatgtaattttttggcccactgacttaaaacataatttgaattagaatttgcttattttatttttctttcagttgataagacttcagcacaaagtatctgatgtggctttaaaatgatttggtttagataagcccgtcatagatgcccgcaggctgcttatagactgttttgtgtttgttggtaccactcattggagaaaaccatgtgcagtattccctagttaatcccctcagcatggtatagtctaacaattttaagtgaccagatgttcatcttctatctagcagttgtgattctttctttctacttgtgtgatttacaggattaaagacaacaactccaggaccaagcctttcacaaggcgtgtcagttgatgaaaaactaatgccaagcgccccagtgaacactacaacatacgtagctgacacagaatcagagcaagcagatacatggtaaagcttcttcattaccgtactattgttattattctatcaataaattaatagtatattcaggaagtaatgccctttatcaggttgtctcttgagagagaaagcatggaagaatgggataccagggaaaatgatatcttaggacaagggtcagcaggttttctgtaaaggagcggcgagtagttattttcggctttgaagactgttgatctctgtcccagctcctccactctgccactgtagcatgaaagtggccatagacgatatgtagtcattgtcaagagacaatacgtagtctcttaaagacaaggatactttccaagaaatgcttccttacacaattttggcattgtgtgaacatcgaacagtgtgttgacataaacctacatggtatagcgtactgtatagtatagatagcccaggggttccttatctctcagccacggtatcagtccatcacctgttaggaaccaggccacacagcagtaggtgatcagcgg

SEQ ID NO: 536 - DNA, 1273 bp, Homo sapiens
atctggctgaaataatgatatcagttcatttacagtgacctgaatatcttatatgtgattttattctgattttccatttttaataaaaaggtactataataatataataataaataataatgaaagtaccataatagtgattttacgtgggaataatttaaaatttttaaacaaaacagaaattgcctaggattatcacctagtttaacttataataggctatgctaagttggtattctgtgtgtgtttgtcagtcgtctatagtggagcaacaatatgtgctgtagggggtgaagaagagtaaggtatcatccttccacaggatgcttaggtaataaaggagttgctttcttgggatggtaaaatatattcagtgtatttttgtctaaaaattatcttctaaggttatattacgttagaactatttaacgatctttgtttctctattaaagttgctgtaaacttgattatttaccttgcattcttttctttttctacagggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaaggtctgtttttgataacttctctcatgtctctgaaaaaaaaatgaaagttttttatactgttgtagaatggtattgtctttagtctgttctgattaagtatgcttctgctgctgcagctttttgaccgctttccctctcagaaatgtccctgatctccttcactagagccactagacagtttctccttcatctccttctatgtatgtacttacgtgttattttacttgccgcaattctcttcaataagaactaaccccctgtctcagctctaaaatcacatttctgctggttttccttgagaaccgctctcactccctctaggaccatattccatcaattattttctcaatttccatattttgaatatattgatcatcccagatttttttcttctgttttcaaaagttcaatctcacctttatttttgaaaaccttctcttgacctggtttcttcctctagctactgctgccttttttcttgtgccgtcccgttaagcttc

SEQ ID NO: 537 - DNA, 1448 bp, Homo sapiens
ataggaaacttttagtgatatattcacatagcatttgcagtatacagtcagtaccgtattgtagatttagtcactctgacttactgtcttgaatccatctctcattaacccatcagattgtattcccagggcagttttccctgcccacaaccttactacgttataaagtaagttgctgtctcttggcaacagtttctttgtatttttatatttttctaccttttcctgtaatttatcaactaatgcaacttaagcagagaagatagagatcaccgtactgctttagccacagggtccgtcagttctatcaaaacagcagaatgtatgtgagttctgcactgttttcaaaggtctatttgttgatttccagtaatattgttaataaaatcaagagtacattgtgaactaaatggagggagtgatgaatattgccaaactaaatggttacttagctgtgttcattttcttgttttgttttcttctttttttttaaatctaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctgtaagtaacattttaaatgagaggtatagtacatagaagcttagaatgctaacaggtactttcgattttgtattgacagtatgagcatccattaatgtctttaacactcagtactatagaaatttgttggttgataaggtaaatggtaaatgttaaaagtacagtgattcttcagtagtgtaaaataaatgaccacaaattaaactttcatatgagattgttttactagatttccaaattaggctgtactattataaaagacatttggctatgatgataagtgtaggagatgcttcagtataagaaacaggcacagaaagatgaagttagtaaaacaaagtatctactcaataaatttttaggatataacatcactaggaattttcattttcatttaggttttgtaatgtccttgtctattttcatgactgttgataatttgtcttacccactttgatctatgaaaacacctgagattattttcttttttgtatacatca

SEQ ID NO: 538 - DNA, 1069 bp, Homo sapiens
gtaaacttgaattcttttaaaatgtttcttttttgattttaaaagtaatacacgatcgtacagacatgtagaaaataaaacagacagtttgttgataatcctaccatctacagacaaccatggttaatattttggtattttctctttccattttattttgcagactgttagtgcaattttgtagtcattttttaaatttacttataatcattttcccatattgttaaatattctctaagcatgtgatttatatggatttagatcgcttccaattctttgtcctgatactgcagtatctctttcaatatatattttcatctcataatttcttttggaaagacagttgaaagccaaatgcctggtcatacataacatgaatatctcttaagtttttagaaaggaaccattttacacttcatcttattcaaaaggccaagaagtgatagaaacataccattttattactcctatgaacagtattttttattttatttctttagcaagaaaatgaaattgggaagaaacgtgaactcaaggaagactcactatggtcagctaaagaaatatctgtgagaaacgttttattaatttttatacagatttggcttacggggactgtcatctcatcaatttttgtgattttacattcttaggattatttctctttcctaattatggcttacttcatgattgtgccttgaaatggattgatcatggtattattattattattattttatttatttgtttatttatttattttgagacggaatctcgctcttgttgcccaggctggaatgcaatggtgtgatctcggctcaccgcaacctcagcctcctgggtttaagctattctcctccctcagcctcccgagtagctaggactacaggcatgtgccaccacgcccgactaattttgaatttttaatagagacggggtttctctatgttggtcaggctggtctggaactcccgacctcaggtgatctgcccgccttggcctcacaaagtgctgggattacaggcttgagccaccatgcacggcctggatagatcgtattataaccatg

SEQ ID NO: 539 - DNA, 1156 bp, Homo sapiens
gtccagaactgatgattgacttttttgaggtgttaagaataataaaagatacaaactcttgagaatcccaaaagtttaagaaaagtagatgaggacctgtagaacaggatatattataatctcagtgtacaattttaatgaaaagcaaacagtgctgagattttgtgtcaataagatatatatctggaggtaaattgtttactgagatgatatttattagaataactactaggttaaaaatgcttcacagtttttagccttctgtcacagatgagtatgttataaatgtttccaaagtttatagagcatttgagtaagtaattttcttatcttgaattagctacaatttgattccaaatacaaagttcaggtacaagaaataaaacatttttactattttttcaggtatttgaacttttttctatagattcccaaatgacaagtgacttttctttgttatttcttctctttcttacctatccatcttaaccccatttaagaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtaggtatttcaactgtatcacaagaggtcagtgtttgaaatgtttttagagataccagtgatgctaaacaaagataaaagcagtttatgttgaaaactgatacttcttctgcttaaaatgctttaaaaaattcctctaggaaggatatgaacttacagttaatgaatatattgaacacctagaatgaaatagatttcatcaagattgaattctttagaggttgctgtttacctggttttctctaccttaagcaggaagtttttgttgataatcacaggatcttctctgttagtctaatattggtctacaactacttgaggaggttctttagctcaggactttatgaagattaaaatgtatttaaaataactaagcatattcagtaattcaaactatagtctatatttacatataaaacacaatataaatatatatgctgagtatgatcatcagacctgagtttctgctcattaaggaactgatacttattttatcagta

SEQ ID NO: 540 - DNA, 1114 bp, Homo sapiens
tttactagtaaacaattaaaatatcaattagaagtataaattgttggcatccccaacatctcctgcttggactctgtgaactggaaagttttgaaaaagatttaaattttcatcaatattagaaagggcttaagctttgaagtcattagaacaaaatacagtgctttgaattgtagtgtttgtgttcatcttgagttgctttaattgttaaatgataaggtaaggccattttaaaataaaaactccaaatgaaaagtgttaaattatttttaatacataaatcccatgacatgtccagatctgtatatagtaatagctataaaagaagggcaaaaacagatgggtttagaacagagttactgctctcacttttatttgtagaatataaacatctttggcacttatgcatgatttaccatctttgctttttaatctttttaaaaaaatggtcatttttgtttgttaatatgatttactgtactacttttattattcaataggtcacatatcctggagcaggaaaacttccacacatcattggaggatcagatctaatagctcatcatgctcgaaagaatacagaactagaagagtggctaaggcaggaaatggaggttagtaggaagtgaggcccagaaacttgcttaaattgcactttggtccattatggtggccttcaagcaaattcttcttaaaaccaaattaaaataagtgacataaagtcattcattcaggagcattcctgagttacagagcattaatctatacccttccataacacttctttaaaagaatactaaatttatttttgttaaaaaaaaaaaaaaaggtgagacctaagaaattcagtttacatcctaatgaaaagggggagataaaagccacaaaaatttaagggaaactaaaagaatgtggaggatattacaaatatatcacttaaatgtatgtcaagggactggcctttttaaatctggggattgtgttttaacaattctgaaaatttcttattcattctcttgaatattagttacctttttactgttttccccattatctccttctggaattccaacttaacgtaagttaaattttcttttccatttgtctttcctgt

SEQ ID NO: 541 - DNA, 1050 bp, Homo sapiens
tgctgtagaagtttagtgagtttgtatttaaaaggacttcagaggagaggtaatttagcagcagcttctaagccctgatgtgggaccaagaacacaggagcctctttaactgtggagctgctctagttgaaggtggggtaaatgttgccctcttagtctcatcagtggtctgacccccaagcactgaaatctcatttagtaaaagggttttgctggaaagagtgtttaaaaactcagcaagctagcaatatactattggttgtctttgagtggagatgggtgggagaaagctgtttagttagagctcttttgtaataatcttagcatggattgaaaatatagaggatcagttgaatgaaatattgtagaggcaagaactcagatgtggtgacctccaggatgtggaaatctctaagatgacagtgacctatcactatagcaattcattaactatatattcaccactgagcaaatgtttgaaattatgttaattttgacaggtacaaaatcaacatgcaaaagaagagtctcttgctgatgatctttttaggtaaagtttgattcacctttctcatgtacctttgagagatgtatataaaatttagttctgttcatagaaattaagaatttgtttcttctgtcctcatagacacctagtcccttcacctaacacaagtgtttatttttattacttaagcacctctcaattgggtttattggctatagcatcgaggtttggggttaagttataagatacttaaaatttgtatgggggcattcaggcaaaaagacggttcccgaattgtgtgaaattgttgtatagatttgtgagatttttcagctctgagtagaattacgattgagttttgaattaagacaagtaaaatgccagaccatttgtttagtttttattggcacatgcataaaaacaaaaggctagattaaagtttcaaagcaggtttttgtgggaggttttagagttgtactttgtgattataatttaattctgatttaatacattttcagcattcctgcaggcctaacaaacct

SEQ ID NO: 542 - DNA, 3277 bp, Homo sapiens
atctcaaaaaaaaaaaaaaaaaaaagtgttgacagacaatactggtttttcattagtcaaatgagatgggttgttcagccatatttgtttaactgctgtaggagaaaatgttgtaaagtgctaattacatttaagtagattatgctcttttgtgcaaatgatatgcttttattatggggaggaatggggatctttgaagccatacagaaagaagtgtaaacataccttcatttttaaactgttttcattaattattttaaagctttaaaggatttttgttattgttgattttttttttgtttttaccatattttcatcaaagcaacatcaaagggatacatgaaaataaaaatgtcagtgcttagtatctgatcctaaggacaaaattgtcattcccatcctatttgccaaagtgtgactacagtttgaaagttctttacctttaaaagaaataccatcccttatctaaatatcatttaaccccatttctttctttgcagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagttgaaaatactgtatttaagtcaaaagtgcatttaatacaccttaacctacgtcatagcttagcctagcctaccttaaatgtactcatgacacagtagcctatagttgggcaaaatcatctaacacaaaagctattttattgtaaagtactgaatatttcatctaatttattgaatagtaaactgaaagcaaaaaacagaatgattgtgtagctactcactataaacatacacagctgaaagcgcactgggcctgaagaatgtttgaagcattgaactaaaattgcggcatgatggggaatactacagcaacaggattatcaatttccctactgattaggcttgagtagaagcattggttgaaggcactaagggcatcaatacttgatggtttagcaggaatagtgttcttcacaaagagcaagaatcagtttttaccctcttgatgctgtggctgacgggaagctacggcttgctgctgctgcccagcattgcaagattga

SEQ ID NO: 543 - DNA, 1500 bp, Homo sapiens
ggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagttgaaaatactgtatttaagtcaaaagtgcatttaatacaccttaacctacgtcatagcttagcctagcctaccttaaatgtactcatgacacagtagcctatagttgggcaaaatcatctaacacaaaagctattttattgtaaagtactgaatatttcatctaatttattgaatagtaaactgaaagcaaaaaacagaatgattgtgtagctactcactataaacatacacagctgaaagcgcactgggcctgaagaatgtttgaagcattgaactaaaattgcggcatgatggggaatactacagcaacaggattatcaatttccctactgattaggcttgagtagaagcattggttgaaggcactaagggcatcaatacttgatggtttagcaggaatagtgttcttcacaaagagcaagaatcagtttttaccctcttgatgctgtggctgacgggaagctacggcttgctgctgctgcccagcattgcaagattgagtattctatgggcacattactagccagggaaaagaacaaaattcaaagtaggctttctactgaatgtctatcactcttgtactaccatctagtcaaaaaatggtaagtcaggactatgcaggaagtctagaagtcagatacatcagtcctctgagcatgtcaatttctatcccaaaaatcggctagaattattgtgctgaatctaaaaatcaatttgtgaagaactgacatcttaaaaatattcagtctttcaatccatgcatgtaaaatgtctattcatttacttagatctactctttccacattgttttgtagtttcactgtagaggctcagacatctgttttaatctgtccctaagcatttttttggtactgtaaacgatactttcagaaagttcatcttgcaatgatttattctatatgaaaatacaattacttttggtgtatagaatttggatcctgtgaacttgctaatctcacctattctggcaaaatttttt

SEQ ID NO: 544 - DNA, 4069 bp, Homo sapiens
gcaggccgaatggtggatttaattggccggagtttagggcgcgcttggcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattcaaaaaaaaaaa

SEQ ID NO: 545 - DNA, 1500 bp, Homo sapiens
ctatgagtatcagagttgtgagaaagcaaagaaaaccaaaataacgatagtaacgttaattgaccacttgccctgtttccaagattttacaaacatatcatgtactgatcataaagaaccaaatcggcagggtgcggtggctcacgcctgtaatgccagcactttgggaggccgaggcgggtcgatcacctgaggtcaagagttagggacctgcctggccaacacggtgaaaccccgtctctaccaaaaaatacaaaaattagccgggcgtggtggcgggcgcctgtaatcccagctactcgagacgctgaggcaggagaatcgcttgaacccgggaggcggaggttgcagtgagcagagatcgcgccgcggccctcaggactgggcgacagagtctccgccccccaacccccttcctcaaaaaaaaagaaccgaatcgtttttagcgcaagttaacagatacaaaaggcagtgtaaaagggcccgaagtccgagctgtaattcgtatgaacaggatgggacttgtcctatcctcccgaaggcactttacccctatgagaaaatcaggaataaatacaaaaggcctcaactggccaagcgcggagtaaacagcaaagccagacggtacacggggcatcgctagataatccgggactaatggccaaagggacaggggttggtggggtaggggcaggttgggaacgccgaccaggcctcaaagggacgcagggttggaaagaggaggatacatatctggacccgcgcaccgtctcgatgtactcagacttgttgtagagcagctcgcccaactccatggccgccgcctccttccctcagccccggatcctgtcagagtcagtcggtcagtctttcagagattccggctacttccggccgctcctccacttccgctccaggtggcccactgggactcatcgacagcgcggctctcctttaggcggcctcgctccactgctcggccgtctacggctgcgcgtgcgcaggccgaatggtggatttaattggccggagtttagggcgcgcttggcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaaggtgccgggggtgcgggaagggcggacgcaggactctgaccccgctttcccagggttttaggcctggctttgtgtcctcggcagtccgagggcagcagtatcatctgaccaccccctcctcttagggctgagggggcacagaaaatgaaaatgtggaaatagcgtggtgctcacgtggtggcgtttaaagaacaaatttcattacagtagcagcgcattaatacaatgtgtaacagtttgtagataaagctgt

SEQ ID NO: 546 - DNA, 1248 bp, Homo sapiens
attcgtatgaacaggatgggacttgtcctatcctcccgaaggcactttacccctatgagaaaatcaggaataaatacaaaaggcctcaactggccaagcgcggagtaaacagcaaagccagacggtacacggggcatcgctagataatccgggactaatggccaaagggacaggggttggtggggtaggggcaggttgggaacgccgaccaggcctcaaagggacgcagggttggaaagaggaggatacatatctggacccgcgcaccgtctcgatgtactcagacttgttgtagagcagctcgcccaactccatggccgccgcctccttccctcagccccggatcctgtcagagtcagtcggtcagtctttcagagattccggctacttccggccgctcctccacttccgctccaggtggcccactgggactcatcgacagcgcggctctcctttaggcggcctcgctccactgctcggccgtctacggctgcgcgtgcgcaggccgaatggtggatttaattggccggagtttagggcgcgcttggcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaaggtgccgggggtgcgggaagggcggacgcaggactctgaccccgctttcccagggttttaggcctggctttgtgtcctcggcagtccgagggcagcagtatcatctgaccaccccctcctcttagggctgagggggcacagaaaatgaaaatgtggaaatagcgtggtgctcacgtggtggcgtttaaagaacaaatttcattacagtagcagcgcattaatacaatgtgtaacagtttgtagataaagctgtatcgacacccttgctcctcccccctcccacaccctcaatctttacttctccccccggacggcctcaagtaaatcttttaagtctggtacttccaggtcctttcgtgtgttaatgtgggtggtggaggaggggcgtatccctaaccaccaaaaaggaatcctatgtatattttttggagaagggaatgttcataaatggtatgatctgaatggttctgcaggttccgtttagctttcctgtcaggacat

SEQ ID NO: 547 - DNA, 1060 bp, Homo sapiens
ctaattgacacatagtgggtatcaattattattccaggtactagagatacctggaccattaacggataaatagaagattcatttgttgagtgactgaggatggcagttcctgctaccttcaaggatctggatgatggggagaaacagagaacatagtgtgagaatactgtggtaaggaaagtacagaggactggtagagtgtctaacctagatttggagaaggacctagaagtctatcccagggaaataaaaatctaagctaaggtttgaggaatcagtaggaattggcaaaggaaggacatgttccagatgataggaacaggttatgcaaagatcctgaaatggtcagagcttggtgctttttgagaaccaaaagtagattgttatggaccagtgctactccctgcctcttgccaagggaccccgccaagcactgcatcccttccctctgactccacctttccacttgcccagtattgttggtgtttttcttcttccagttaaaggagaaattagcattcttgaaaagggaatacagcaagacactagcccgccttcaggtaagtgaatcgtattctcaaattaaggtgttatagtacaaacaatttaaaaacagttcttgactctataaaactttaaagaaaacgtatttctggggctgtttttgtctcctctagcgtgcccaaagagctgaaaagattaagcattctattaagaaaacagtagaagaacaagattgtttgtctcagcaggatctctcaccgcagctaaaacactcaggtaaatctagaccattcacttatgcctgctttattattcatttcccaggtatattttggctattgttctttttcccacagtgtgaagataatgactagcaatagacgctttaattttaattttaattttaattttatttttttgagacagagtctcactctttgttacccaggctggagtgcagtggcacaatcttggctcactacaacctccaactcccaggctcaagtgattctcgtgcctcagcctcctgagtagctgggactacaggcacgtgcac

SEQ ID NO: 548 - DNA, 1103 bp, Homo sapiens
aaagtacagaggactggtagagtgtctaacctagatttggagaaggacctagaagtctatcccagggaaataaaaatctaagctaaggtttgaggaatcagtaggaattggcaaaggaaggacatgttccagatgataggaacaggttatgcaaagatcctgaaatggtcagagcttggtgctttttgagaaccaaaagtagattgttatggaccagtgctactccctgcctcttgccaagggaccccgccaagcactgcatcccttccctctgactccacctttccacttgcccagtattgttggtgtttttcttcttccagttaaaggagaaattagcattcttgaaaagggaatacagcaagacactagcccgccttcaggtaagtgaatcgtattctcaaattaaggtgttatagtacaaacaatttaaaaacagttcttgactctataaaactttaaagaaaacgtatttctggggctgtttttgtctcctctagcgtgcccaaagagctgaaaagattaagcattctattaagaaaacagtagaagaacaagattgtttgtctcagcaggatctctcaccgcagctaaaacactcaggtaaatctagaccattcacttatgcctgctttattattcatttcccaggtatattttggctattgttctttttcccacagtgtgaagataatgactagcaatagacgctttaattttaattttaattttaattttatttttttgagacagagtctcactctttgttacccaggctggagtgcagtggcacaatcttggctcactacaacctccaactcccaggctcaagtgattctcgtgcctcagcctcctgagtagctgggactacaggcacgtgcactaccacacctgactaattgttatatttttagtagagatggggtttcgccatgttggccaggccggtcttgaacccctggcttcaaatgatctgtctgcctgggcctcccaaagtgctgggatacaggtgtgagccactgtgcccggctgcaatatattctaattaacataaaattcatatgccgtaaaatctatagtctctattttcagttagactgttt

SEQ ID NO: 549 - DNA, 2473 bp, Homo sapiens
tgggagtgttattaaaattacttgagccaagggggaaaataaagaaagaaatacatgagatagaaaactagttgagatttagaagttaagagaagagattgtgtgataaagaatactctgttcgtttaaaaaacatttttagcacaatgctgtttgtttatatgtacttaaaatttcatagattattagaatttaaaaaatcagaacttttaaaaatatgtacagtatggagtatgtacagttcctttacatactccatcagatagtagaagtagtcaacaccttgaacacattcctcctaaaggtaacagtgaccttactactcacagcctaaaaaataggtttatttcacctgtaaattcatctgcctgaatgaaatgtcactgattctttcttaaataaatgtttagtagtatttatatataataggttaaaaatgagtattttttgttttattttataagaaaaatataagttatatacatttttttcctcctcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaaggtaaatcaagatgtgtttgatgatgatgatgatgatgatgaaagttaacaattactatttgcctggcacttccttttctttcttttctaaaaagtgacagggccaagtgtggtggcttacgtctgtaatcccagcactttgggaggctgaggaacagagtgagaccctggctcaaaaaaatttaaataaataaataaataaataaataaataaataaataaaaataaagagacaggggctcactgttgtccaggctggagtgccgtggtgcagcctctatctcctgggctcaaatgttcctcctgcctcagcctcccaactagctgggactactggcatgtaccaccatgcctggctaatgttttaaaattttttgtagaggtgaggtcctgccctgttgcccaggctgatcttgaactcctggcctcaaacaatcctcccaccacagcctctcaaagtgctgggattacagacgtgagccactgtgtccagcttgcctg

SEQ ID NO: 550 - DNA, 1830 bp, Homo sapiens
atttttatttatttatttattgtttttaaagacagtctcactgtgttgcccaggctggtctggaactcctgggctcaagcaattctcttaccttgacctctgaaagtactaggattacagctgtgagctaccatacctggctagcaatacactgttttgggtagtgcagaaaaatagctgctaattaatcaactaactcatgaccgttgtttgaacccttcgcccaagtttctgagtcatggatgggaaaagtaatgaacattttttagtatatttgagtttagaagctcactctttgttgggtattacatttaagaatggtttaacatgtttctttgataggacttcattgtaaacattaagttcattctggggaaattaaggttcattaaaatgtttcttttaaatctaggagatcctattctctttgtcatcagtgaaacagattgtctgttttgttgggttttgttactattttgtgacttatttttcttctttagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacaggtacaatccatttcctctgtgaaattttctctgaaggaatgaaatgccttagtgaatgtaaacagcatgacttgcttgcgcattgggccttccacgtttaagaatggtttgacgtgtttctttgatatgatttcattgtaatcattaagttcattctggggaaattaaggttcattaaaatgtttcttttaaatatgggaggtcctattctctttgttatcagtgaaacagtttgcatttggagctttgctgctgttataagaggaaataaagacaatacgaagtagacattttgatgagtgggtaatgcaggcagacattatacataaagtgtagactaatgatgtgacttttgttttcacagactgaaacagcagagcttcctgcttctgatagcataaacccaggcaacctacaattggtttcagagttaaaggtcagaagaatattctcttccagtgtctcgtgtcttacatatgaaaactttaatgaactgaaaa

SEQ ID NO: 551 - DNA, 1072 bp, Homo sapiens
caggcaaggacaacctacctgtgactgtgactctgtcccgccaggaacacctccacccattgagtcattcacttttaaagaaaatcagctctgtagaaacacatgccaggagctgcataaacattccgtcgaacaggtacaatccatttcctctgtgaaattttctctgaaggaatgaaatgccttagtgaatgtaaacagcatgacttgcttgcgcattgggccttccacgtttaagaatggtttgacgtgtttctttgatatgatttcattgtaatcattaagttcattctggggaaattaaggttcattaaaatgtttcttttaaatatgggaggtcctattctctttgttatcagtgaaacagtttgcatttggagctttgctgctgttataagaggaaataaagacaatacgaagtagacattttgatgagtgggtaatgcaggcagacattatacataaagtgtagactaatgatgtgacttttgttttcacagactgaaacagcagagcttcctgcttctgatagcataaacccaggcaacctacaattggtttcagagttaaaggtcagaagaatattctcttccagtgtctcgtgtcttacatatgaaaactttaatgaactgaaaagaattcagtcatatagcttcttgttctttaatactattaaagatattggtaaacagattcagaaaaacagatttggattggttatttttcccaatatttacctctgtttatgttttgagctctcctcttaaagtttctatgccaacctattggcaagaacaacttaggctaagtaactgaacttcatgtctaaatctaagttagggagctgggcacggtggctcacccctataatctcagcactttgggaggctgaagcgggctgatcacttgaggtcagatgtttgaggccagcctggccaacatgatgaaaccccatctctactaaaaatacaaaaattagccgggcgtggtggtgggcgcctataatcccagctgctagggaggctgagggaagagaatacttgaactgggagacagacgttgcagtgagcca

SEQ ID NO: 552 - DNA, 1162 bp, Homo sapiens
tgtaaccccagcactttgggaggccgaggtgggtggatcacttgaggtcaggagttcaagaccagcctggccaaatggtgaaaccttgtctctactaaaaatacaaaaattagctgggtgtggtggcgggcgcctgtaatcctagctactcggaaggctgaggcaggagaatcgcttgaacccgggaggcgaaggttgcagtaagccgagattgcaccactgcactccagcctgggtgataaagtgagactcagtcccaaaaacacccaaaaattaaaattaataaaataaataaaaaataaaatctttcatgatgtaagtttgataggcatttttttaggtacataagaaccacaaagctctttcttttcacctgcataagacttaaattttacatacctactgtttcattgaattataattcatcactttgcatacttatgctttgcataaaacagcactcgagtgccactttaacagaactgttgccattgtgtcagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggtaagtgggaatctcgagctgaaagagatctttgcagccatttgcctgataatgtagatgggcagcttaccaaaattgggagctatgaccatgcaaggcagaacagagatgaggtttttttcccaacattttattatgaaaagtttcaaacatccagaaaagttgtatagtgagcacccatatacccaccattctagactctaccattaacatcctgctttgttcgctttatcacaaatttttgtttgtttgtttgagacagggtctcactctgtcatgcaggctggagtgcagtggcatgatcacggctcactgcagtttcaacctccccaggctcagtaatcctctcacctcaccctcccaagtagctgggaccacaggcatgcaccaccatgtctggctaattttttattgtatttttttcttcttctttttattgagatggagtcctgctctgtcacccaggctggagtgcagtggcatgatctcggctcactgtc

SEQ ID NO: 553 - DNA, 1086 bp, Homo sapiens
ttgcaatgagctgagattgtgccattgcactcaaggctgggcaacaagagtgaaactccgactcaaaaaaaaaaatttccttgttcctgtagagtcttcatacttgaatatacctcattcttgctctccaaatatatacaacatctaacactgtgctttacacagaggtgcccaataaatatttgttcagtgaacatagatatacttttaaatggctgcataaatattctttacattcacatgccaaaatatacccaattattcccctattgttagaattataccttgcattaggtaaatgctcagtaagcactattatgctattatgcatatagtttatttagatttacagctaataaaaagagttttctgagccttcaaatgatgaaaattatccttgtacagtgagaatacaaaagaatgtgataaattttggaaaatctggattaaacaaaaatgaaacaaccaagcataatttttggctgctttgttttatttaggttccagtattacagatagttccagtgcctgatgtgtataatctcgtgtgtgtagctttgggaaatttggaaatcagagagatcaggtatgtaattcccaaggagtgatttgtttttccttcatctttgtctctgtcagctggttttaagtgcaggtaataacctaggcttgagtcttgaaagaatctgaaagatctaaagagagagagatttgtttaaaaaaaaatcaatagaatgacatccctgactgaagtttctatttaaaatgtgaacctaggctgggcgcagtggctcacgcctgtaatcccagcactttgggaggccaaggaaggtggatcaactgaggtcaggagtttgagaccagcctggccaacatggtgaaactgtgtctctactgaaaatacaaaaattagcctggtgtatagcacctgcgggtgcctataatcccagctactcaggaggctgaggcaggagaattgcctgaacccgggaaacagaggttgcagtgagctaagatcgtgccaccactgcattccttctggatgacagagtgagactttgtctcaaaaaaaaaaaaaaaaaaaaa

SEQ ID NO: 554 - DNA, 1162 bp, Homo sapiens
gaggcaggagaattgcctgaacccgggaaacagaggttgcagtgagctaagatcgtgccaccactgcattccttctggatgacagagtgagactttgtctcaaaaaaaaaaaaaaaaaaaaaaaaaaaaggccgggtatggtggctcacacctgtaatcccagcactttgggaggccgaggcaggtggatcacgaggtcaggagttcgagaccagcctgaccaacatggtgaaaccccgtctctacaaaaatacagaaaaattagccaggtgtggtggtgcgcacctataatcccagctactcaggaggctgaggcaggacagtcgcttgaacctgggaggcagagttgcagtgagccaagattgtgccactgcactccagcctaggcgacagagcaagactctgtctcaaaaaaaaaaaaaaaaaaaaagtgaacctagtcctttaatattaaaaggttactcctcacatcaccccatttttccttatatttggcttagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggagggtaagaaaagcattgattgatttttaactattagatgaagaatgattttatcacaggtttcagagaaagttgggtaactaggatctcgtttttctgtgctgggggtgtaatataagcatgtaccgcatcaacactaggttatgacatagaagcaggttagtgaggtggaagccagacatgtcagggatgaagtcaaagaaggtgagaggctcagcaaatgtagtttgttcttcagtcttcttgaaatctgtgtgtcccttaaatgttagaaatacctctgctgggcacagtggctcatgcccataatcccagccctttgggaggccaaggcagaagtttgagcccaggagttcaagaccagttggggccacatagcagggccccatctttacaaaaaatttaaaaattagctgggtgtggcagagcatgccttgtggtcccagctactagggagtctgaggtggaaggatcacttgagctcaggagttcaagggtgcagt

SEQ ID NO: 555 - DNA, 1117 bp, Homo sapiens
gcagacagatttctgagagatgagaagataaaattactgggacttggtgattgactagattgagaggaaggagagaatatcaacatggtagggttggtcacttgagtggtgaccaagctcgaaatgtgggtattatccttgtctccttccccccagtctaggtggtcacttgagtggtgaccaaccctgaaacttggacattagatggtgatgcaattcattgagataggaatgcagaaagaaacaaaaggtttatagaaaaagttaacaagtttaattttgaatataatgaattcgaggtgcttgcagcatatctaggtagatattatgaaagtaatatatgttcattgtagaaagtttagtatacacgttttctgggttagatttttttttcctgatattaggttagtttatattatgcagttcaacaatgcggagaagggctacctagagactgctttagtgcaaagtactgacttttcatactgttttaattacagaggcaaagaaaaccaatttttgatgccccctgaggagactatactaacttttgctgaggtccaagggatgcaagaagctctgcttggtactactattatgaacaacattgttatttggtaagctttccctctaggtcctcagttccctcatctgtagtatgaggatatacctctaattttacagggttgttgtgaagattaaataagagagtatgtgtaaacatgattgtggttttgtgttgctgttgttgttgtttttgttgtgttttgagacagagtctcctcctatcacccaggtgggagtacagtggtatgatctcggctcactgcaacctctgcctcctggattcaagtgattctcctgcctcagcctcccgagtagctgggattataggcatgtgccaccacacccagctaatttttgtattttttagtagagatagggtttcatcatgttggccaggttggtcttgaactcctggcctcaagtgatccacctgcctcagactcccaaaatgcagggattacaggagtgagccaccgtgcctggctaatttttgtattttttagtagagaagggattttgccatgttggctaggttggtcttgaactcctg

SEQ ID NO: 556 - DNA, 1088 bp, Homo sapiens
ctcttcctaccccacttcaatccttccttctatccattattttggtctagttgtagtataaatacatgtaatagagatataattgtaactctcttttaggtgtagtctcttgccctacaaaatttggtttcctggccgttgtcttccatggaaaatttagacataacaagaagtgtcacaaaatcatgatactgctataccatgtgcctgatttcaataccaggttgaatgagatgatggaaccttcctcatggaatttggagagatttatccctaggggcattgtagatttaatctaaggctgaactatcaaatgaaactattggcaaaattaacccacagttctacttttacctaaatctatgactaaagaaaactaaggagctcttagttttttccctggtcacctcctaagacatgctatgatgaataagaaaatattttctgaatactggtttgttggaagaatgtgatcagcttatttatttttgttatctaaggaatttaaaaactggtcaactcctgaaaaagatgcacattgatgattcttaccaagcttcagtctgtcacaaagcctattctgaaatggtaagtaatgactggctgggaccactttgtgtgttactgttggtctcattaagtgagagcagtaagtcataagcagtaatgaacaaaccttccccgtggcatcttttttcaaaattggatagcaatgtttgtcctttcttgaaatttaggatgaaaataagtgttggtacagtgattgcttggtaaattttctggctgtaggacctgagggcaaatatttatttctagctgtggatttgaactgagaactattatgcctgttatcagacttgactcccagccacattgccatgtttaagtagccttaggaaggatgattaaatgatccaataatcccagaaatacttttttttttttttgggatggagttttgctcttgttgcccaggctggagtgcaatggcgcgatctcagctcactgcaacctctgccttctaggttcaattaattgtcctgcctcagtcttccaagtagctgggattacaggtgcccgccaccaca

SEQ ID NO: 557 - DNA, 1149 bp, Homo sapiens
tgtcctcattctctctttgccaatatttccccaaatgaatggcatgaaatgtagtactatctaaggggaaggaaatggatgaatcagattcatgcctggcaagactggctaaaacaaacactgggaaccggaagcaggagaagctaaagctagaagttggctgagcgcggtggctgacgtctgtaatcccaacactttgggaggctgaggtgggaggatcccttgaggccaggtgttcaacaacagcctgggtaacacaggaaggccttgtctctaaaaaaaaaaagaagaagaacaagaagccagaagtccagtccagtaataatctcaacagttcctagacggcagggaaaaaaatcaagccagtggttaaatcctggatacttcagagcctatcggtcattgctttaattgtttggtttttgtctctgccagatctttatttttcctgacatactcttgacagtctatttgggatatttatttttctccgaaattaggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggcaagtgtgcataactgctactctatgggtgggacattctgaaaggcactgtgcaaacacaaaaactagatatttttgtgtcacttagaagaatggaaaacatgaaatactatatatcatgataggaatattcagaagtaggatgaagattagtggacttgagtcaaaccccagattccctgcatcctgatctctactagtatggggttatataggtttttaatagtgtttattcaagccctgttttttcccctaaggtaaatattttggcagcacatggtggatcatgcctgtaatcccagcactttgggaggtcaaggtgggaggagagcttgagcccaggagtttgagaccaacttggacaacagagcaagacccagtctctaccaaaaaaaatatatatatatattagccaaacatgctggcatgcatctgtacttccagctactcgggaggctgaggtgggaggatggcttgaacctgggaggtggaggctgcag

SEQ ID NO: 558 - DNA, 1508 bp, Homo sapiens
aatagtgaaaagtgcaatgaagataaaaacatatatgtcataaagatggaacagatcccgtatgtgtgtgcacactgcctgagatagaggattaggggtgacctttctatggacataacaggcctgaatgatgacaagaactcagccatgctaagagctggggtgagagcctgtcagggagaaagaatggcaagagcagtgacactgagttgggactgagtttggccagagtgatggagagtggaaggaaggccactgtgcgccagccttcaattgctacaagatgcatcagagagattggcaggaactggacatgtgattctgtccaaaactgcaacacaatagccaacagacctctaaggctacaaatgtaggcattcatagttacagggatttttgttcctgttgctggttttgggaacatggttttgaccttttttttttttttaattgttttttggatatgtaatctgaattatatcttctttgtatgctatcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattctgcttggcatgttattgtttcccattctttcaagatcatttgcagaagcaagaactaattattatacaaccaggatatttaatcaatagtctttgcctagtaagtgtaaatttcagttcagttaacttactacactaatatgcaatatactttttgtgctatttgtaatactttatttttacatacatactaaaataaaatgaaacctactaaaatatcctaatttagggatactcttactctttttcattctcatgcatctttcatgccagtgctgcattatcactagagtcacctttttttgagatggagcctcactggtcacccaggcgggagtgcagtggcatgatctcggctcattgcaacctctgcctcccaggttaagtgattcccctgcttcagcctctcaagtagctgggattacaggcacccaccaccacacctggctaatttttgtattttaatagagatgggggtctcaccatgttggtcaggcaggc

SEQ ID NO: 559 - DNA, 1500 bp, Homo sapiens
aaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttatttttatacattctgcttggcatgttattgtttcccattctttcaagatcatttgcagaagcaagaactaattattatacaaccaggatatttaatcaatagtctttgcctagtaagtgtaaatttcagttcagttaacttactacactaatatgcaatatactttttgtgctatttgtaatactttatttttacatacatactaaaataaaatgaaacctactaaaatatcctaatttagggatactcttactctttttcattctcatgcatctttcatgccagtgctgcattatcactagagtcacctttttttgagatggagcctcactggtcacccaggcgggagtgcagtggcatgatctcggctcattgcaacctctgcctcccaggttaagtgattcccctgcttcagcctctcaagtagctgggattacaggcacccaccaccacacctggctaatttttgtattttaatagagatgggggtctcaccatgttggtcaggcaggccttgaactcctgacctcaagtgatccacctgctttgacctcccaaagtgctgggattacaggcatgaaccactgccgctcttttttttcttggttttttgttttttgttttttttttagaacggagtctccctctatcacccaggctagagtgcagtggggtgatctgggctcactgcaacctccgcctcccaggttcaagtgattctcatgcctcagcctcctgagtagctgggattacaggcatgctctactatacccggctaatttttatattgtttgtagagacagggtttcactgtgttggccaggctagtctggaactcctgaccttaggtgatctgcctacgtcggcctcccaaagtactgggattacagggatgagctaccgtgcccagccaaagaagattatattttttaaagacaaatttttgggccgggcgcagtggatcacgcctgtaatcccagcactttgggaggccaaggtgggcagatcactag

SEQ ID NO: 560 - DNA, 3724 bp, Homo sapiens
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaaaaaaaaaaaaaa

SEQ ID NO: 561 - DNA, 3538 bp, Homo sapiens
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcaaaaaaaaaaaaaaaaaa

SEQ ID NO: 562 - DNA, 3421 bp, Homo sapiens
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaaatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagagtctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcaaaaaaaaaaaaaaaaaa

SEQ ID NO: 563 - DNA, 3052 bp, Homo sapiens
ggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggttttaattacaacaagaacggctgctgataattttagcacccagtatgttttagatggcagtggccacatactttctcagaaaccttcacatcttggtcaaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggcagttatttggcagaaaagcagagtatcagatcacaagatggctctcatgtcagttctggggactgctgttatgaacaatatggaatcctttcagtaccactctgaagaatctcagatttatctcagtggatttcttccaaagtgtgatgcagaccactctttcactagtctttcaacaccagaaagaagtttcatcttcataaacagtcgaccagtacatcaaaaagatatcttaaagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaatctttttaatggatctcattatttagacgttttatataaaatgacagcagatgaccaaagatacagtggatcaacttacctgtctgatcctcgtcttacagcgaatggtttcaagataaaattgataccaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcaaaaaaaaaaaaaaaaaa

SEQ ID NO: 564 - DNA, 2851 bp, Homo sapiens
agccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccagaaaaaaaaaaaaaaaa

SEQ ID NO: 565 - DNA, 1500 bp, Homo sapiens
gttgctgagagtggtctcaaactcttgggattcaattgatcctcccgcctcagtctcccaaagcgctgagactccaggcgtgaaccaccgcgcccgacctggaaagatacatacatatatatatatatatattttttttttttttttttttttttttgagatagagtttagctcttgttgcccaggctcgagtgcaatggctcgatctcagctcactgcaaactccgcctccagggttcaaacgattctcctgcctcagcctcccgagtagctgggattacaggcgcctcaccacacccggccaatttctgtatttttagtagagacgaggttttaccatgttggccaggctagtctcgaactcctgacctcaggtgatccgcccgcctcggcctcccaaagtgctgggattacaggcgtgagccacggcgcccggcctggataaatcttttaaaacataaaagtctgagtgagtccctggccggccggcacagatgccggggtggggccgtgaaccggttgggacgcgctcgctccggcctggggggacccgggccagcagccggtcgccgcgcgtgcgcactgggcggggggccccgcgctcctacctgcacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgcagtccggtgtgctctgattggcccaggctctttgacgtcacgaagtcgacctttgacagagccaataggcgaaaaggagagacgggaagtatttttgccgccccgcccggaaagggtggagcacaacgtcgaaagcagccaatgggagttcaggaggcggagcgcctgtgggagccctggagggaactttcccagtccccgaggcggatcgggtgttgcatccatggagcgagctgagagctcgaggtgagcggggctcgcagtcttccggtgtcccctctcgcgcgccctctttgagacccacggcattccaacctccctggaaatggggggaacatggccgaggcgcgtggcgaggcagccccctggaggccccggagtggcgacctcagtgttgcagcgatctcgtgccccttgggtgcgccttgaggccgaggcaagctccttcggggtcctgggctgcgggcaaaggattcggccctgtgaggagttgggttcggcctgtcccagacaggccttgcccacatcccatcacagggccgtggacttgaagcgggagcgtgaaatccccatagactgaatgcatttcctttctacctgttctctctccccttttatttttatttttatagtatt

SEQ ID NO: 566 - DNA, 1110 bp, Homo sapiens
gggtggggccgtgaaccggttgggacgcgctcgctccggcctggggggacccgggccagcagccggtcgccgcgcgtgcgcactgggcggggggccccgcgctcctacctgcacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgcagtccggtgtgctctgattggcccaggctctttgacgtcacgaagtcgacctttgacagagccaataggcgaaaaggagagacgggaagtatttttgccgccccgcccggaaagggtggagcacaacgtcgaaagcagccaatgggagttcaggaggcggagcgcctgtgggagccctggagggaactttcccagtccccgaggcggatcgggtgttgcatccatggagcgagctgagagctcgaggtgagcggggctcgcagtcttccggtgtcccctctcgcgcgccctctttgagacccacggcattccaacctccctggaaatggggggaacatggccgaggcgcgtggcgaggcagccccctggaggccccggagtggcgacctcagtgttgcagcgatctcgtgccccttgggtgcgccttgaggccgaggcaagctccttcggggtcctgggctgcgggcaaaggattcggccctgtgaggagttgggttcggcctgtcccagacaggccttgcccacatcccatcacagggccgtggacttgaagcgggagcgtgaaatccccatagactgaatgcatttcctttctacctgttctctctccccttttatttttatttttatagtattttatttttaatttttttttgtagagacggggatttcgctgcgttgcccaggctggtctcgaacgcctgagctcaagcaatccgcccgccttggcccctcaaagtgctgga

SEQ ID NO: 567 - DNA, 1140 bp, Homo sapiens
acaggtgcccaccaccatgcctggctaattttttgtatttttagtaaagacggggtttcaccgtgttggccaggctggtgtcgaactcctgacctcaagttatccacccatctctgcttcccaaagtgctgggattacaggcatgagccaccacagccagccatgctttcacttttcaagaaagaagacaccattgttgccaaagattttggtaatttgagagatacaatgtatgttttctccatgtggatcttagtataattagatagtaaggatctgttgaatttgaagtatctatccagaagtattttgggtacatgtttaaggattgtaaaacagtgtttctatttctggatataataaatgtatttgctaatataataaatgaatagattagacccataaattatttacagtgttgagtcatttcccacagttaaaatcaggatgaaaatatatagctgaatacttgatttgtttcttgtaactgatttctctagtacagaacctgctaaggccatcaaacctattgatcggaagtcagtccatcagatttgctctgggcaggtggtactgagtctaagcactgcggtaaaggagttagtagaaaacagtctggatgctggtgccactaatattggtaagtttgggagagttttaagccacaagaaatgatctgtgaatgttgttgtagttaagaaacatttgttattgaaataagactatcaagtgttgatgtagtaataaattattatttttaagttgaagttagcacctattatgtgcctagtacttagctaggtagtaataataataacagcttttattgtgttcttacggtgtgccaggcaggtgttatgctaagaattgcacagaaatatttaatttgcagaacagctgggcgtggtgtctcacgcctataatcctagccctttgagaggccgaggtgggggaattgcttgaggccaagagttcaagaccaacctggccaacatggtgagaccttgtctctattgaaaaataaagtaggccaggcatagtggctcacgcctgtaatcccagcactttgggaggccaaggcgggtggatacctgaggtcaggagttcgagaccagcctgtccaaagtggtgaaactctgt

SEQ ID NO: 568 - DNA, 1087 bp, Homo sapiens
tttttagtagagacagggtttctccatgttggtcaggctggtctcgaactcctgacctcaggtgatctgctcgctttggcctcccaaagtgctggaattacaggcatgaaccactgcacccggtccccgttctctttattgggtatgttaaaattatttctttcaaaagaaaaggatggtcaaagtgcaacgcggtttacagctaattgatcaccaccagttacagattttttttgttccttctccactccaactgcttcacttcactagcctagggaaaaaaaaagaggaaagaaagaaaaagctaaactatttagtctgggctagtaaatagccagaaaggactttataacaatgaaatatacaaaatgacactagtatgtttaactaaaggtatagttatgactcttaaatttgcatatgttataaataatgtcaatataaaaactgatagcatgggtccgtttttaataaatatgtaaatattttaaactttctagatctaaagcttaaggactatggagtggatcttattgaagtttcagacaatggatgtggggtagaagaagaaaacttcgaaggcttaagtaagttgactttttctaatcctattataaaataattgggtcacatgtctcagaattttgagtaacactgtcttgggaaatgcaaaaacagttttttaaagccagttactagatatcatgtatattttgttgttatagcacttgagatatcttagtccttactttacactctctttcagctctgaaacatcacacatctaagattcaagagtttgccgacctaactcaggttgaaacttttggctttcggggggaagctctgagctcactttgtgcactgaggtgatacaatatttttatccactcacttgaccccttagagaaacctctctgaaaattaattggaatcattattattttcagttttctatctcaacatctcaacttctagcttctgaattctgttttgtctcgctgccaatctaagtcatagtacttctgaaatgtgagcaataaatgaatgaaatgaagcaaatagtattgttaaaaagatggttacc

SEQ ID NO: 569 - DNA, 1103 bp, Homo sapiens
ctagcctagggaaaaaaaaagaggaaagaaagaaaaagctaaactatttagtctgggctagtaaatagccagaaaggactttataacaatgaaatatacaaaatgacactagtatgtttaactaaaggtatagttatgactcttaaatttgcatatgttataaataatgtcaatataaaaactgatagcatgggtccgtttttaataaatatgtaaatattttaaactttctagatctaaagcttaaggactatggagtggatcttattgaagtttcagacaatggatgtggggtagaagaagaaaacttcgaaggcttaagtaagttgactttttctaatcctattataaaataattgggtcacatgtctcagaattttgagtaacactgtcttgggaaatgcaaaaacagttttttaaagccagttactagatatcatgtatattttgttgttatagcacttgagatatcttagtccttactttacactctctttcagctctgaaacatcacacatctaagattcaagagtttgccgacctaactcaggttgaaacttttggctttcggggggaagctctgagctcactttgtgcactgaggtgatacaatatttttatccactcacttgaccccttagagaaacctctctgaaaattaattggaatcattattattttcagttttctatctcaacatctcaacttctagcttctgaattctgttttgtctcgctgccaatctaagtcatagtacttctgaaatgtgagcaataaatgaatgaaatgaagcaaatagtattgttaaaaagatggttacccttattaaaacagtaattctcaattttaacctaacatgtagataataaatgatagttaccattggttttcattatcaatttttagggaaacatttcaccaaagcactatttaattatagcacagatatgaaatttttataaataattatatatatatatatatatctttttttttttttagacagagtctctctttgtcacccaggctggagtgcagtggcacagtctcggctcactgcaatctctgccttccaggttcaagtgattctcgtgcctgagcct

SEQ ID NO: 570 - DNA, 1184 bp, Homo sapiens
tttttagtagagatgggatttcaccatgttgcctaggctggtctcaaactcctggcctcaagtgatctgcctgccttggcctcccaaagtgctgggataacaggcatgagccaccacgctctgccctacatatacattttaattataatatttgttagattctttaaaaaaaatttgttcgaagagtaataacaaaacaaatctgtgtttgtgaataaataaatcttaagatcatttatggttttgcagttcaacctgaaaaacgaaatcaaagcttttatcaaagcaaagcatgtttagtgctctctgtctcactgtcttttagatgccaaaccttagattttatgatgactcctcaaccatttagatcttgattatctcagagggatcgtcagctttttaagaaaattttgagagaaaagcaagtgaagaaaagagtagtcagtgcccaacatcatgggtctctcactgaacacaccatgcctggtattctctcacagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggtacagtaaattaatcctggttttcaagagtattggttaatgcacatgagcaaaagatttactaaagatgtttattcttcagttgattctcttcccataaattattgagaaatgctttatttgcatttctcattaaagatttaacattaaagacttaactttaggatgatttacttttttcttttcatcacatagtgtttattaggactgggcaacacagtgagaccctgtctctatgaaaaattttaaaaaaaaatttactgggcatggtgacatgtacctgtagttccagctacttgggaggctgaagtgggaggatcacttgagcccaggaacttgaggctgcagtgagctatgattgcgccactgcacttaagactgggagacagaataagatcctgtctggaaaaatatatatacatatatatatattttttattttttatttttatctttttttgagatggagtttctctttggcgccctggctggagtgcggt

SEQ ID NO: 571 - DNA, 1168 bp, Homo sapiens
caccgaggctggagtgcagtggtgcaatcatggctcactgcagccttgaactcctaggctcaagcgatcctcccacctcagcctcctcagtagctgtgactacaggcacatgccatgacgcccggctaattttttttttaaattttttgtagagacagggtcttgctgtgttgcccaggctggtcttgaactcctggtctcaagtgatcctcctgccctcagcctcctgagtagctgggattacaggctgtactttttagttgttttaccaggatgcatggcacattgggaagtgagaggactgtgaccaggagccaaaagctctgcgttcctttctgtagaatataggaagacacctctttacagatcattctgtcaacagtgcttcccttgatttgtgcgatgatgtgagaaccttgcgttggatgttgtaacttgagctgtgtaattcctataatattaaagtaatgtagaatattgtgtttgtgttttttaaacaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcaggtagtgatggccggttacttcaacgcctcttattgctctagtgattatagcgggtttccattgtcccttccagtagaatggagaataaaatcttagaattgattttttttttttttttgagagggagtctcgcactgctgcccaggctggagtgcagtggtgttgtcttggctcactgcaacctccgcctcccagattcaagcaattctcctgcctcagcctcccgagtagtgggattacaagcatgctccactacgccaggctaattttttgtatctttagtagagacggggtttcaccgtgttggccaggctggtctcgaattcctgacctcgtgatccaccagcctcggcctcccaaagtgctgggattacaggtgtgagccaccaagcccggccggttttttttttttttgagctggagtcttgctctgttgcccaggttggagtgcagtggcgccatcttggctcactgcaacctctgcctcccgcgttgaagca

SEQ ID NO: 572 - DNA, 1098 bp, Homo sapiens
tttcatctttcttatatcataaaatcaaaattgttgttcccacggctcacacatgtaatcccagcactctgggagaggaaactgttgggattatgtgtttgaaccacccggccaacaattttgaggtgggagaatcgcttgagcccaggaatttaagaccagcttggataacacggcaagatcccatctctacaaaaaaattaaaaaattagccaggtgtggtggtgtgcacctgtagtcccagctactcactcgacaggctgacgcaggaggattgcttgaacccacgagtttgacattgcagtgaggtatgattgagccattgtactccagcctgggcaatagagggagaccctgtctcaaaaaacaaaacaaaacaaaagattcttttaattttttttgcgcttgtaatgtcaatagcttgactaagaaagaaaacagattaagtccactctgtctttattaggaagtaactgtgaatttttttttttttttttcagttgcaaagcctcattccttttgttcagctgccccctagtgactccgtgtgtgaagagtacggtttgagctgttccgatgctctgcataatcttttttagtaagtagattgctggcaagagaactacaattgaacattttatcctgagagctttttttttaaagatagtgattctaaggctaatagtttcgtgtctttttttttttttcttgagacggagtcttgctttgttgcccaggctggagtgcaatggtgctatcttggctcactgcaacctctacctcctgagttcaagcaattctcctgcctcagcctcctgagtagctgggattacaggcacgtgccaccacacccggctaattttgtatttttagtagagacggggtttcaccatgttggccaggctggtctcgaactcctgacctcagatgatccgcccaccttggtgtcccaaagtgctgggattacaggcatgagccaccacgcctggctagggataatagttttttatgtcctttataaaactgtgagcaatgctgtggctaagaaagatgatttatacaaaggagtcagttgcttaattcaaaccatgttttgag

SEQ ID NO: 573 - DNA, 1100 bp, Homo sapiens
tggaaatgccggtatccctggggtgggtctcatgtgaagcaagcgctttaccaagacatgagatataagcgtcctacccgggaggttttgaaaggggagggaatgtgggcaaaattctgagcacaagtggttagacttcattgacaaaccaggggtggcagcacggaggttctgagaatgcatttgaagcgagacccacttacagaggctgaggatttatcaggaagggtaaggagagctgcaacacatcagttttggacgcactgcatcacctgtggtgcattggttgactgtaggagctttagaatattccagaaggtttggttctttgatgactcatcaagatttggagcacagatacccgtgaactgcaatagtgatccttatcagcatgtcacctggtgttttgttttcatttcactttaagaatgtgccatgtgatcgtatttctaatccctttcactctggaatcctgcccttaccatattaatgttgaatagcatctcaggtttcatttcacaatgcacgcatggagttggaaggagttcaacagacagacagtttttctttatcaaccggcggccttgtgacccagcaaaggtatttaaaatttttttgtgttagtttgttctttatgcctttgacttttaattgataacttttttctgataataggcagtttacgtggagctcgggactttgagaaacatggctttaacattatcttattttgtgcatttacagaagtctaccgcagatggcccccagcttcagatgtttcaactgaagacttttctgtccgggcgcagtggctcatgcctgtaatcccagcactttgggaggccgaggcgggtggattgcctgaggccaggagttcgagaccagcctggccaacatgacaaaaccccgtctctactaaaatacaaaaaataaccaggcatggtgttccacgcctgtaatcccagctacatgggaggctgaggcaggaggatcacttgaacctgggagatggagcttgcagtaagccgagattatgccactgcactccagcctgggtgacagagcgagactgtgtttcaaaaaaatatatatatattttt

SEQ ID NO: 574 - DNA, 1085 bp, Homo sapiens
aactgaggtcaggagttcgagaccagcctggccaacatggtgaaaccccatctctactaaaaacacaaaaattatctggtcatggtggcgtgtgcctgtaatcccagctactctggaggctgagtcaggataatcacttgagccccggaggcagaggttgcagtgagccaagatcgtgccattacactccagtctgggtaacaagagcgagactccgttgaaaaaaaaaaagaaaaaaaaatcctgcctgtaatccaagttacatgtcaggctgacacaggaggatcacttgagcctgggaggttgaggctgcagtgagccatgattgctccactgcactccaggctgtgacaaggcgagaccttgactcaaaaaaaaaaaaaacaaaaaagtatccccttctaagaacatgctggttggttagaatagaatgttgttagaatgcggggggctgggaacatttgtcatttattcttttctactccttgtattttgtgcaggtctgcagactcgtgaatgaggtctaccacatgtataatcgacaccagtatccatttgttgttcttaacatttctgttgattcaggtaagttccattggcatttcagtacaactagtgactaatgcctcaaagaataaaatgaaattctacagctctgctatgactggaatgagataacaatttatggtcatgtaagttttttgtttttgtttttttttgagacggggtcttgctctgtcacccaggctggagtgtggtggcgtgatctcggctcactgcaacctctgcctcccgggttcaagcgattctcctgactcagcctcccaagtagctgggactacaggtgcgtgccaccacacctggctaattttttgtatttttagtagagacagggtttcaccgtgttagccaggatggtctcgatctcctgacctcgtgatctgcccgtcttggcctcccaaagtgctgggattacaggcatgagccaccgtgcctggccctataattttttttttttttaaacagagttcccgctttctacttgagactatgttaattatattgttaggaaaatgtaatttttt

SEQ ID NO: 575 - DNA, 1156 bp, Homo sapiens
aattgtcttttgctcatttatttgaaaaagctgatttcataacttatgaatcttaacctggacactgtaatgtttttaatagcacttgtgataaatacaagtgaatgaaataatagatggggaaatttctattgttaaaagtgaatttggctgggcgcggtggctcacgcctgtaatcccagaactttgggaggccaaggcgggtggatcacttgaggttgtgagttcgagaccagcctggccaacacggtgaaaccccatctctactaaaaatacaaaaattagccagtgtggtggcacttgcctgtaatcctagctacttcggaggctgaggcagggagaatcacttgaacccaggaggcggaggttgcagtgagctgagatcgcgccactgcactccagcctaggcgacagagtgagacgctgtctgaaaataataattaataaataaaataaaagtgaatttaaacataataaatatgttttcttttttgccttagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaagaaaaatacagtgtacaaacagcttctaaagcttttagctaatgtgtttccttattttttccaagtaaacttttttttgacatgaaaacaaagtctcttatattattttatcatttttaattcttttttgagacagggacttgctctgtcacccaggctggactgcagtggtgccattgtagctcactgcagcatcacactcctgggctcaggccatcttcctgcctcagcctcccaagtagctgcctccaagtacctctagttttttgtaaactgtaaacggatgaagtcatataagatatatgattagaagaagtctgcagtgactgcatttttaactcccttgtcatgtctgtttttttgagatggagtttcgctcttgtcacccaggctggagtgcaatgatgcgatctcagctcactgcaaccttgaagcctcccacgttcaagagattctcctgcctcagcctcctgagtagctgggattacaggcgccc

SEQ ID NO: 576 - DNA, 1862 bp, Homo sapiens
accattctggtgagtatatggccatattgcattgtgttgtggttttttttttttttttttttttttttgagacagagtgttgctctgtcacccaggctggagagcagtggtggcatcttggctcactgcaacctctgcctcccgggctaaagggattctcgtgcctcagcctcccaagtagctgggatgacagatatgccaccacacccggctaatttttgtatttttagtagaaacagggttttaccatgttgtccagaccagtcctgaactcctagcctcatgtgatccccctgccttggcctcctaaagtgctgggataacaggcgtaagccaccacacctggcccatattatagttttattttgaacattgaactgtgttcatctgtgtaattagcatgtggatctcctcttttgtgaagtatctgttcacataagcacgtcctctcaccatttcaggatagtccctgaccctcttctccgtccacgtttgcttaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataaggtaaagttttaattttttactttttctctttttatctaaaatttttatttttattttttatttttttgagacagagtcttgctctgttgcgcaggctggaatgcagtggcatgatcttggctcactgcagcctccacctcccgggttcaagcgtttctcctgcctcagcctcctgagtagctgggattacaggtgcacgccaccatgcctggctaatttttatatttttggtggaaacagggtttcaccatgttggctgggctggtctcgaactcctgacttcaggtgatccagccaccttggcctcccaaagtgctgggattacaggtgtgagccaccacacccggccaggtaaagttttttcttaagagtattttgaggctaggtgtggtggctcacacctgtaatcccagtactttgggaggccaagccaaggagggaggatcacttgagcccaggagttcaagaccagcctggacaacatagggagacctcgtctc

SEQ ID NO: 577 - DNA, 1168 bp, Homo sapiens
tcgttaatagtagcaactgatgtcttctccggagagttggatgaatgaataattaatgttatctttagaaagtgggatggttaagccgaacgcagtggctcacgcctgtaatcccagcactttgggaggccaaggcgggcagatcatgaggtcaggagttcgagaccagcctgaccaacatggtggaactctgtctctactaaaaatacaaaaattagctgggcatggtggcgcacctgtaatcccagctactcaggaggctgaggcagaagaatcactcgaacccgggaggtggaggttgcagtgagccaagattgtgccattgcactgtagcctgggtgacagaacgagactctgtttcaaaaaaaaagaaagcgggatggctagggactttattttgtttttgtattgtttgactttttttttattacagtgttctataacataatcagaaaaataatcttgtaaaatgtctgataattaacattttctacctgcagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcgtgagtgtgtttagtgttcattcccagactccccctcaaattgaagatctaatagaggccaaggcaggaggatcacaagaggccaggagtttgagaccagcccggacaacacagcaagaccttgtatctactttaaaaaagaagagatctaggaaggaggggtgtaaaaaataaaaaatatctagttggccaggcgcggtgcctcacacctgtaatcccagcactttgggaggccgaggcaggcagatcacctgaggtcaggagttggagaccagcctggccaacgtggtgaaaccccgcctctactaaaaatacaaaaaggccaggcacggtggctcacgcctataatcccggcactttgggaggccgaggtgggcagatcacttcaggtcgggagttcgagaccagcctgaccaacatggtgagacctgtctctactaaaaatacaaaattagccaggcgtggtggcgggcgcctgtagtcccagctacttgggaggc

SEQ ID NO: 578 - DNA, 1101 bp, Homo sapiens
agagtcttgttgtgtcgcccaggctggagtacagtggcgtgatcttggctctcactacaacctctgcctccctcctgggttcaaacgaatctcatgcctaagcctcccaagtagctgggactacaggcgtgcgccaccatgcctggcctaatttttatatttttagtagagagagtgtttcgctgtgttgaccaggccggtctcaaactcctggcctcaagagatctgcctgcctcgggctcctaaagtgctgagattacaggcgtgagccaccgcacctggcctgtagctactttaacttctaaaaagaactttaagaaagagaaaattaaaaggaacttctcaggaagttttgtgacacttagctgagtagtgttgttatttgtgttgttattttgacatgaattcaaaatacagtattgttgttttcatttcatttctgctgtaaagctaaatgtttgacttcaggatatggtttgaatcatttttgtgtttttcagacctcagactctcaacttaactgctgttaatgaagctgttctgatagaaaatctggaaatatttagaaagaatggctttgattttgttatcgatgaaaatggtaagttattaattagaactatagcggctgggtgtggtggctcacgtctgtaatcccagcactctgggaggccaaggcgggcagatcgcctgaggtcaggagtttgagaccagcctggctaacatggtgaaaccccatctctactgaaaatacaaaaagtagccgggcgtggtggcgggtgcctgtaatcccagctactcaggaggctgaggtgggagaatcgcttgaacccgggaggtggaggttgcagtgagccgagatcacgtcactgcactccagcctgggcaacaagagtgaaactctgtctcaaaaaaaaaaaaaaatcagaactatagattcttgtctttttagagctgggaataatctttcaggtcatatagaccagttttttttaattttataaaagattaaaaagttcctccaaaaagcattttgtgagtttcctctctttcaggtgttcactttttttttttctgagatggagtcttgctctgtcgccc

SEQ ID NO: 579 - DNA, 1170 bp, Homo sapiens
cttgtctttttagagctgggaataatctttcaggtcatatagaccagttttttttaattttataaaagattaaaaagttcctccaaaaagcattttgtgagtttcctctctttcaggtgttcactttttttttttctgagatggagtcttgctctgtcgcccaggctggagcgcagtggtgccgatctcggctcactgcaagctccgcctcccaggttcacaccattctcctgcctcagcctcccgagtagctgggactacaggtgcctgccaccacacccagctaattttttctattttttagtagagacggggtttcaccatgttagccaggatggtctgtatctcctgacctcatgatccgctggcctcagcctcccaaagtgcagggattacaggcgtgagccaccacgcccggcctcagatgttcatcctaagtagctttcaagtgaaacgtgtttgtcaagtcatggatttttctcaaaattgtattcttttagctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtaagtaaagaaagcctggctgtcagctcagctgctcaagcttgcagtcgaggaaggtctcagcccagctcctgatttggtcaaggttgtaaacgcctttgtgattgccaggggtcattttacacagagagctacgtgcagcgtcgtagctgagcatctgtgtcgtctgcgttctctgtgaccttgaactcataattattgctcttttgttacctctgttaagcagtattcttggccgggcatggtggctcaagcctctaatcccagcactttgggaagctgaggcgggcggatcacgagttcaggagatcgagaccatcctggctaacatggtgaaagcccgtctctactaaaaatacaaaaaaattagccgggcgtggtgtcgggcgcctatagtcccagctactcgggaggctgaggcaggagaatggcgtgaacccagaaggcggaacttgcagtgagccaagttcataccactgcactccaacctgggcgacaga

SEQ ID NO: 580 - DNA, 1304 bp, Homo sapiens
aggaagggaggcattcgtgcttggaggtgggggtgcaggcacagcccagcgagggccaagtcaggggacagacgggggcttttattcaggtgagggggagagctgtgaagtggaatgaataacctgacagccctttaaaagtaatcactggctgctgagtggagagcggctcggaggggtcgcagtggggcagggaggcctgctgggaggctgctgcacctgccagggtgagagggcagggtggctgctgagacaggtgtggtcggcgtctggagtggaggcggtgccaccttgaaggagccacaaggagcctgatttcacagaagggtggagggctgagatctagaacctaggcttctctgggggaaggtttttcagggaaggtagtttttgagctgtaatcttgtccagccttattttagagaagaatgcttctgaagagctgccattctgacgtcaaaaaactactaaaacgttgaaccattgtgtctcacactcaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcggatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagaacaagactgtgtctcaaaaaacaaaacaaaacaaaacaaaaaaaaaaaaaccaaaccactttggaagttactcaggcctctgctctggctggacatagtttagtctataactttcaacccttaatgataattaaat

SEQ ID NO: 581 - DNA, 1500 bp, Homo sapiens
aaggagcctgatttcacagaagggtggagggctgagatctagaacctaggcttctctgggggaaggtttttcagggaaggtagtttttgagctgtaatcttgtccagccttattttagagaagaatgcttctgaagagctgccattctgacgtcaaaaaactactaaaacgttgaaccattgtgtctcacactcaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcggatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagaacaagactgtgtctcaaaaaacaaaacaaaacaaaacaaaaaaaaaaaaaccaaaccactttggaagttactcaggcctctgctctggctggacatagtttagtctataactttcaacccttaatgataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccctcagatggaggaggcagtaca

SEQ ID NO: 582 - DNA, 8065 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 583 - DNA, 7911 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 584 - DNA, 7957 bp, Homo sapiens
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 585 - DNA, 7675 bp, Homo sapiens
actcacacctctccaggaaaagcagcagacaaatggggattgaaaaattcaaaccctccctctggtcctgggaggaaagggctgtctgaggtccgcagggggtggaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 586 - DNA, 7658 bp, Homo sapiens
actcacacctctccaggaaaagcagcagacaaatggggattgaaaaattcaaaccctccctctggtcctgggaggaaagggctgtctgaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 587 - DNA, 7757 bp, Homo sapiens
gaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 588 - DNA, 7831 bp, Homo sapiens
aattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagataaaaaaaaaaaaaa

SEQ ID NO: 589 - DNA, 5572 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaaaaaaaaaaaaaaaaaaaaaa

SEQ ID NO: 590 - DNA, 1500 bp, Homo sapiens
acgtgcacggtccggccggggcgcgcggagcctggccccgggcgatccatcctgccgggttttcacggcggccaagggggggcggggctaggtggtctctgagaaccgagcttgactccgacgccgcgaaccgacctggagcccgaggggaaagatgctcgactctcttgggggcaccggagcgggcgcaggagaggcctgcggggtgcgtcccactcacagggatcctctttcagttcatttagataggtgccctttgggcccttgaaattcaacggctatgtgttcacgttcagcacgctcggctgagagctttcatttttagggcaaacgagccgagttaccggggaagcgagaggtggggcgctgcaagggagccggatgaggtgatacacgctggcgacacaatagcaggttgctctttgtgctaagactgacaccatgaggacacagatttgggggaagggggaatctctaggcaaaggctgttacagtcaaatctctgcgaacgattgtgatccgacagcggtgcaaaaggaaagagcgaatgcagtccacgccgcggaaatctaggggtagaggcaaggggggagggtattccccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcgg

SEQ ID NO: 591 - DNA, 2111 bp, Homo sapiens
ctctgcgaacgattgtgatccgacagcggtgcaaaaggaaagagcgaatgcagtccacgccgcggaaatctaggggtagaggcaaggggggagggtattccccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagatt

SEQ ID NO: 592 - DNA, 1085 bp, Homo sapiens
gtctaattatcatgtagaataggaaattgcggtctagaaaggttaagtgacttgtccaaattacacaactagttagagacatagccagctcttaaatctgacttccagattttcactgtgtcttcttttttctgtaacgtgttgccttttttagccatgaaaaattagaagttgaactcttgtcttttcaggcaggtgtcaattttggggttttgttttgatttttggtttttgacataaagtactttagttctgtgatgtataaaccgtgagtttctgtttttctcatatacctgaatactgtccatgtggaagttaccttttatctttaccagtattaacacataaatggttatacataaatacattgaccaccttttattactccagctatagtggggaaaactttcttttcataactagctaatgttttaaaaagtattcttttagtttgattgctgcatatttcagatatttctttccttaactaaagtactcagatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgtgatatcatttcctggactccataaaatgctggtcaccaggtttaatacctggattccattacagtgtgatttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtg

SEQ ID NO: 593 - DNA, 1045 bp, Homo sapiens
tgtttaatacctttgtacagaattaatagttagtacgtggatctttcaaatatcaaaagttttcagtttgatgggaaaatgatgtctgaattttcagggttatttttaagagtacttgattatgactgtcttgtaaatctctatgagctaggtatacttgcactaaatgctaatgctttttaaagaagttatgtcttaatattcagtctcattatgttaggttgaagatagaagattatgaaaatattctctgaaaagctctggttttacttcagattgtataaatctgtgtaatgtaataattatttaagaatgacatgattactactctaaacccatagaaggggtatttgttggattatttattttcacttaaatggtatttgagattaggaaaaagaaaatctgtcttttggtttttcttgatagtattaatgtaatttcaaatgttagctcatttttgttaatggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttgttagagtgaggtagagttaaagatacattttaacagaattgtattcctaaaccgattaagtcaagaagtccaagagcattgttagatcatttagaaagtgtagtgatgaggtaaaacattgttggcacagattcatgttacttgatctgctttaaatgacttggcatctagcccatatttgagcccataaccgtgtggtaatttgaagtgtaattcacagtagagcttctgttaaagcactaatagcatcttccatggaggtatacttcagagtgaatataattttgtttatcctgtgtctctagagctattgactgaaaaagctgttagggcattctctaactgtacatcacctaagttatttaaaattgctgaattaggtggcttgtcttgtctaggacagagttttaaggactgcccacctgat

SEQ ID NO: 594 - DNA, 1044 bp, Homo sapiens
aacaacattcagtttttctttactgtccttatgcttttactatttttaacatatatctttttgaagaatagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaac

SEQ ID NO: 595 - DNA, 1239 bp, Homo sapiens
cctttaaataacacacttagcatttttattttatgaaatgtaatatgtagttctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaaaacaggttttaaagatagttgctaatccttatttcttctaaatttttaaatcagttgctgcctcaatttctatatgagaaatgactgattgatttcatttttctgttcacgctaccatt

SEQ ID NO: 596 - DNA, 1142 bp, Homo sapiens
ccagcatcactttttgctactgctgtttctgccttaaaggcaatatgcctctgtctagtttgctgattctgatactctttcccctggaaagtaggtaatcaagtttgtgaggagctgtgtgtttaaggagtccataaatccttgtggggagccctaggtgtatagagcatagctgtagggcagaggcctttgacacttattctggatatgcagtggcctttgcctatggggttcatgggtcagagcgctgttgtgacctttgaataaatgggttgttatgataattgttttaagggaggagagttattctgatatcctttgtattgatattgctcttatttattattgagctggatttaagtattaatcatttaaggtcaaatttctaatgtatatatgttcttaaatggctacgacccagttaccatagcaatttagtgaaataactataatggaacattttttttcaatttggcttctcttttttttctgtccaccagggagtaactattcccagtcagaggcgctatgtgtattattatagctacctgttaaagaatcatctggattatagaccagtggcactgttgtttcacaagatgatgtttgaaactattccaatgttcagtggcggaacttgcagtaagtgcttgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacgtggcagcaagctgaagtatgatgagtaaagaataggaatcaaa

SEQ ID NO: 597 - DNA, 1167 bp, Homo sapiens
ccgcatgctagagacttaagaatactatagcaaatatctgtcttctttacatttaaaaatttttcgtgactactccctgttgatatctgtcttaaaagttacttttgatgtagttcacaaatgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactat

SEQ ID NO: 598 - DNA, 1225 bp, Homo sapiens
aagtaaacatgtatttgccatgcgtcatcagggaagttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattcttcgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctacaaggcccagcataatttagca

SEQ ID NO: 599 - DNA, 4489 bp, Homo sapiens
ctttgggaggctgaggcaggcagattgcctgagctcaggagtttgagatcagcctgggcaacatcatgaaccccatttctactaaaatacaaaaaattatctgggcatggtggtgtacacctgtagccctagctgtttgggaggctaaggcacgagaattgcttgaacccgggaggcagaggttgcagtgagccaagatcatgccactgcactccagcttggcaacagagcaagactcttgtctccagaaataaaaataaataaattgtattaacatcctgatagtttatctgtttagtacctagcaagaaagaaaatgttgaacatcttaagaagagggtcatttaaaaggcctcttaaagatcatgtttgttacagtgcttaaaaattaatatgttcatctgcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtact

SEQ ID NO: 600 - DNA, 1500 bp, Homo sapiens
cagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagaccctt

SEQ ID NO: 601 - DNA, 6597 bp, Homo sapiens
tttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttca

SEQ ID NO: 602 - DNA, 1500 bp, Homo sapiens
aattttaatgttttgttccattagttattttaactattttgtaataactgacactttccggttttttttaacctggtacagcaagagactatttctcactggtcttccccacttgcatcctttggcacatacatttatgtattaggttctgtaaattatttgcttgggattgtatgactggagaaacatttcctacatttttccaaggcaggcagaggcaaattataccactacagtaattccaaatttgtgtttcatttaaatgtcctccactattgtttcagtaatttttatgtatgtttctctaggcccttaaatgtgatatccctccattaagtttgtttccaagaaagcaatattctcagttacttctgagacaggtaacttctctttcccttatttttaaagatatctattgctgggagcactgatcggaatggattacctctacattcttcatatttgcagactgcttttagttttagttcccagacttttggtcttaaagacgcctttacactaaaaaattacgggggacctcaaagagcgtgtacgtgagttataattatcaacatttactcaattagaaattaaaattggtatttctaagcgcaagaatacacatgcgcacattccattaaccgccactgcaatggcgtcatcacatgttatgtgatcactggaaattactacacgaacgttagagagagaatgagaatgaaaaggaaaatagttttgacacgaactgaccccgcttcctgggtctccaatccaccccaccactacccccattccaggagtcccaggatcaagctttgggaagcgccatccgtcacaggtcttggtctccccttccaaaagtcagtgcctctccaggctgcccatccccagcaaagatccggaagtccgctgcccctggcaacagcacccagcacctagccctctgcttcgccgtaccgcacccggaagtcggagctgcgcacgcaccgcgggactctgatttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaatt

SEQ ID NO: 603 - DNA, 1530 bp, Homo sapiens
tcttaaagacgcctttacactaaaaaattacgggggacctcaaagagcgtgtacgtgagttataattatcaacatttactcaattagaaattaaaattggtatttctaagcgcaagaatacacatgcgcacattccattaaccgccactgcaatggcgtcatcacatgttatgtgatcactggaaattactacacgaacgttagagagagaatgagaatgaaaaggaaaatagttttgacacgaactgaccccgcttcctgggtctccaatccaccccaccactacccccattccaggagtcccaggatcaagctttgggaagcgccatccgtcacaggtcttggtctccccttccaaaagtcagtgcctctccaggctgcccatccccagcaaagatccggaagtccgctgcccctggcaacagcacccagcacctagccctctgcttcgccgtaccgcacccggaagtcggagctgcgcacgcaccgcgggactctgatttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacggtaagtcttcagtagccgccttcagtttacaggtcgctacatctttcggagaataaaatgggaagttgagaactctccttaggagcagaagcgtccctagggctccacaggtgtaggcccttaaagtgccttagggtgtggcctgcaggctacagcgaccttaggagtttgcctgaagcagtctcggaaggatgtccggacctggcctggggacaaggtttacttaagaatcccacgataccgggagctgtcgccgctcactcagagttcagttcccactggatgccctttggtctgtattgatgtttttaacgctgtctccttgctttcaaagcatagcattcacttcccagtagttgtcccatacaagaattcctttaaaagttataaaatgatacatacatgactaaagagtttccaagtatgccaactgtccagacataatacatggaaaataaataaattcaaaatgtaactgatgtagtggggcttaacttgga

SEQ ID NO: 604 - DNA, 1084 bp, Homo sapiens
agccgtttgggaggctgaggctgggggattgcttgagcccaggaggtcgagaggtcgaggctgcagtaagccatgatcatgcagctgcactgcagcctgggcagcagaatgagaccctgtctcttaaacaaaaagttcctacagcctggagttaatgtgagaattaaataaatgtatgtaagagtgcttagtacaatacagtacttaactgttagccattcttattattaacttaaattagtttaaagggtttcagttgaaaataattatttttttcccaagtaacaattcttcatattaggataacttcttagttatatagcatttctgtgaacttacagcattaacacttaatcatatttttattacaggttttataatgtcagattttatcttttatagtttccatgataaataatatttttgtaatgaattcatattttatggtaaacttctgtggttctcttataacgaaataatgtaattttctatttctttagaccatcattgaatgtctaaaatatatttgtactggagatttccctcctggaaccaaaggaaatacatttgtacacgatcccaaggtaatggtgctagtacaattttgtatttttataattataaaaatgataatagcttattatagaaaacttggcactggaaaactataaagagaaatgaaagtcagccccacacagttttagcacccagtagtaaccgttgttgacattttcatgtgttttcctcctcctttaaatactgttttatatagctgatgtcatactcttaattttgtattctgggtttttttccccacttaacattatcatgaagtcctatgtcattaaaaaactatcatctgggtgtttggtatgtaagtgtttcttttaatctttatactgctttgtatgtctgagatattttctacttaaagtgcatgaacactttagtagttatgtaattttcttacattagattgctttcagtttttcattaaaatgtaccatgataagccaggcttgggggtgtgtgccaatactcccagatagctctagaggctgagatgggaggattgcttcagccc

SEQ ID NO: 605 - DNA, 1152 bp, Homo sapiens
agcttgtgcggggaaactccttcttataaaaccatcaggtctcgtgagacttactcactgtcacaagaacagcatgggaaagacctgtccccatgattcaattaccttcaactgggtacctcctgcaacatgtggaaattcaagatgagatttgggtggagacaaagacaaaccaaatcattctacctttctataaacttgcaatttttaaggataaaaaacatttttgatgcttacagagataaaattcatttatttgaaaaatctgcatacctgatctcctaatgatgctgaataaaggaggtagatagtatatcatttttgtaaattaattaaacagtattcttctatattttggatagcatgtaaaaatatcactcattttggatgtttttctttttgttccctcattttgggtaagattgcttatgcctttttctcagaaccaacactggtgcttattaaagtaacataagttttttctgtgttttccttcaaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagtaggtgtttatatgatatttgaatttctgttcattttcagtcttttaggtctgtaagttgatggttgttttctactataagtttaggggagcatattaaatttttttcaatagactttagactttatttttttagagcagttttgggtttatagcaaaattgggcagaaagtactgagcttccattttctccctacccccacgcacacacagcctcctccactatgaacatttgattttttgtggatactatttgtcagttaaatagaatgatcccatgaaagacttagggttatgttccattctcttgagtaatttctgaacagttgctgaattgaaagcacataatcactcaaatacaggttgaatgagtaaaaaattctagtgtcatgtttaagaatgggtgagatgagaagcagacaagtaggaaagaatgataaattgttcctttcaaccattatcattctgttagaggcaggtatcattttctaatggatatg

SEQ ID NO: 606 - DNA, 1186 bp, Homo sapiens
ccgtgcctggcccagtgtaatattttcaaaatacaaattgaaatgtataaaaaacagtaaagacagatattgcctctgctcaccagagcagtctgttactgaagaaagaaccccattctaagatgtttttaacttacctttgcctgtctgctattgatcatcatgttttgttttattctttgtctcttatttttaagacagttaatgctctatatagtatctctaagtattctaaattattatatttaaaagtccaaatatgtaaaaaataaattctggcttcctttcctgaactactttgttttacatatcttttcatctgtgaaccgttaaatagtttaagagttacactttttagcatgatgaagccatttctaacgggataggtgaagggcctttttttttattcttttaaagaagtacagtatgaattgattaagcaatagaatagatacactgaaggttattttacatatattcttgattttcattttctgtaggcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaaggtttgtaacccttaaatagactttgtagtccattaagttattgaactgtgtttgcaatttggatgcttctttttaacagaaaaaatttaaaaagcagaaaggtcatcagttactacctctcatccagcagcaaccattgggcatattttctttcacttgtctttctgtgcgtatatttatttacctgattgacagtataaatgtaatttttttcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaagga

SEQ ID NO: 607 - DNA, 1205 bp, Homo sapiens
ccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaaggtttgtaacccttaaatagactttgtagtccattaagttattgaactgtgtttgcaatttggatgcttctttttaacagaaaaaatttaaaaagcagaaaggtcatcagttactacctctcatccagcagcaaccattgggcatattttctttcacttgtctttctgtgcgtatatttatttacctgattgacagtataaatgtaatttttttcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaaggtaacttgattttatttttaattgacaaaaattgtatatctttatggtatacagcatgatgttttgatataagtatacatcgtggactggctaaatcaagctatttaacgttcattacttcaatttttttatggtgagaacacttaaaatctactctcttagcaattatatattgttattaactaaagtcacagtgatgtacagtagttaatttcttgtatactaaataggtagtcctttttttgctatagtagcattctccccttatttgtatatgaaactgaatggcttgtatatttcttgaattatcagggagctaatgttttaggtctatgttagtctttaaattgctgaaagagcttggatttgaaagaaaacaaatttgtagcatcacactaaattagtagtatagatcactaggtgttaaatagcaatatcattacccaaccttacagttctgtattaatatttttaaaaattgacatctttctagagaattt

SEQ ID NO: 608 - DNA, 1129 bp, Homo sapiens
aggccactgagctcccttgttgtactttacttgctcagagtcctctgtggttgagcaagctttggattaaagtatactcttcatgtaaatttgcctataggctcagaatgcattggtaactcaccatgaatttctagccttctcagtagtcctgacttaaaaaaatacattaaatagttacctttttaaggattaagtaactctaaatgcccaatgaatgaataatgacttttgtggcaggtgttgaggacaggacatggtgtttggagttagaagtggaatttaattcctgcttctctctactagctgtgaggacttgggccaagttacttaatgtctctgaacttcagtttctctaggcctgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttacacaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtaggacaaaatgtttatttggtcgtttttcctactatgatgttatacattttctgtatgaatgaagaatctccaaggacttatgctgagtgaaaagccaa

SEQ ID NO: 609 - DNA, 1166 bp, Homo sapiens
tgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttacacaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtaggacaaaatgtttatttggtcgtttttcctactatgatgttatacattttctgtatgaatgaagaatctccaaggacttatgctgagtgaaaagccaatcttaaaaggctatacacagtatgtttccatttatataacatttttataatgtcaaaattttagaaatagtggagaaattagtggttgccagggatactgggtaagagaaaggacaggagggagctaggtatggttatgattagaacaaaaagagagtccttgtagtattggaactgttcagtatcttgactgccatagtggatatatgaaccgacacaggtgataaaattatatagaacttaatatacacacatccacatgctcaggggtacaaataaaattggggaaatttgaataagattgatgaattatatcaatatcagtattctggttgtgatattttactgcagttttgcaaaatgttatcattgggagaaactgggcaaaatgtacaagag

SEQ ID NO: 610 - DNA, 1194 bp, Homo sapiens
ccaatcttaaaaggctatacacagtatgtttccatttatataacatttttataatgtcaaaattttagaaatagtggagaaattagtggttgccagggatactgggtaagagaaaggacaggagggagctaggtatggttatgattagaacaaaaagagagtccttgtagtattggaactgttcagtatcttgactgccatagtggatatatgaaccgacacaggtgataaaattatatagaacttaatatacacacatccacatgctcaggggtacaaataaaattggggaaatttgaataagattgatgaattatatcaatatcagtattctggttgtgatattttactgcagttttgcaaaatgttatcattgggagaaactgggcaaaatgtacaagagacacactgcattattttttataactcgtgaatctgcagctatctcaactttttaagcaccagttgaaaaaaaaattatgagattttttttttaaaaggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatggcaagtattttgaaatacagtatttgttattttgtttgcatcatattctctacttgaattgttttaatttttggttggactccattttggcatatttttctattagtgttaggataaaatctgctacaaggcagaaaaacctttattgaagcaaatgttcttaagtgtataaagataaaaatatgaagaaaatgtaaacctacattttttatttggttttaagtaaaaatttttaaaaactaattgcagagaaaacatttgctcacagttaatgattatctctgggtaatggttttgattgtttttaaaatacagtcttgaaccacatgttttggtcagtgatagaccacatatttgacattggtcccataaaattataatactgtattttactgtatgttttctgtgtttagatatgtttagatacataaatacttatcatcatgttacagttgccaaagtattcagtacagtaatatgctgtataggtttgtagccca

SEQ ID NO: 611 - DNA, 1207 bp, Homo sapiens
gaaaacatttgctcacagttaatgattatctctgggtaatggttttgattgtttttaaaatacagtcttgaaccacatgttttggtcagtgatagaccacatatttgacattggtcccataaaattataatactgtattttactgtatgttttctgtgtttagatatgtttagatacataaatacttatcatcatgttacagttgccaaagtattcagtacagtaatatgctgtataggtttgtagcccataaacaataggctataccatatagtctatgtgtgtattaaactataccatgtaggcttatgtaaatacattctgatgttcacacaatgataaaattgcctaatgatgcatttcttggaatatatccctgctgagcaacacacgactgtacttttttgtattttcttcagtgtacatatattccttttgcaattaaaaaacttaaattgtttagtaaattattaatgctcattctttacatatgcatttagaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgtaagatattgtttgaataatctaataattttaagatataatacttttagaagtattttgtctatttttgatcctaagattatagcattttaataaaaacatcaactttgtcttattctcatgtaaaatgaattcatctgaatatcttgatcttctgactctttggttctacaacccgatagcctgaaaattagaatcacatagggagctttttaaagatactgtactcagaccttaaagcttcagaccttccaaatcaaaatctctgagaatggggcatagaaatgtacattcaaaacacaacaaaactggctaattcttatgagcaccttgattaagaacacttaccaggccgggtgcggtgtctcacacctgtaatcccagcactttgggaagccaaggcaggcagataacgtgaggtcaggagttcaagacctgtccagccaacatggtgaaaccccgtctctactaaaaatacaaaaattagctgggcgtggtgg

SEQ ID NO: 612 - DNA, 1183 bp, Homo sapiens
atgtaaacatttatttttgctccataactcaccattgtagcatacatttttgtcagtttagcacttcatcagtgttgtcttgttggggtggggagatacttggtcagggaccacatcacactatttttatagtttctacataccaggcaatatagtgaattacatggggacataataaatatttaattgttgactgaggactcactaatctgtgtacttagacacatgtctcctaattttacagtaattctcacatttctttcctgtttgacccttctaggtttatttactaattctctaccattataacatagtaaggtcactttaataagatataccttagagcatatatagtgccttatgtttttttctcttgttggatgcaaacagtaatatttggaacattctgaggagtagttaatttctaatacactttgtcattattttaattcttgcacaaaatatataacacctttgcatttgtatgaattattgactaggaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagtatgatttttctttttgttctaattatactgtctggtacttaaaatagcctaccttgcactcataagtcatagactataaggtattaagttggtattgactatattttagaggctaagtgagcttagtactctatataatagactttcaagcttaaaagttattgtttaattacaaaaagttaatacagaaatgtatatatatgtatatacacacatgcacattactgttaacttttaacatacacaaattttaaaattttatattgttcgacttggtactccactcttaaggcttagaaagaccatccccacttgaagactttaagaactttaagaaattttatattttattttcatatttttatagttttaagcttagaactttagtcagtctagaatttatttttgttcttgatataatgtggagatatagactttatttttaaaagattttttttttacctataggctgacaaagatgaacaaatcagaaaaata

SEQ ID NO: 613 - DNA, 1158 bp, Homo sapiens
acccaaatggagatgctgaccaaagacaaagtatgatttttctttttgttctaattatactgtctggtacttaaaatagcctaccttgcactcataagtcatagactataaggtattaagttggtattgactatattttagaggctaagtgagcttagtactctatataatagactttcaagcttaaaagttattgtttaattacaaaaagttaatacagaaatgtatatatatgtatatacacacatgcacattactgttaacttttaacatacacaaattttaaaattttatattgttcgacttggtactccactcttaaggcttagaaagaccatccccacttgaagactttaagaactttaagaaattttatattttattttcatatttttatagttttaagcttagaactttagtcagtctagaatttatttttgttcttgatataatgtggagatatagactttatttttaaaagattttttttttacctataggctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaagtaagttgcaacatttggagatgtaatagaaatctcttatttcatgcttacctgtttaattgttttaaaataatttattgtcatgaaatggtatgttatattgataaactttagttcttacatacaaggagacttcagaaagttcatggaaaaatggaattaaaagataaaaattttaaataaactgtatttctcaacataagctccatcaagttcaagactcttctgagcagtgataccagcaatttagttcagtcctaaagaactgagggtcctgggaatttaaccatgtcagtgtagtcttttttacattgctagcataaaaatgggtgccctttaaagatttttttaagattaagaaactagaagacaggaggagccaaatcaggactgtaaggtggatgcctaatgatttcccatcgaaactcttgcaaatggcccttgtttgatgagaggaatgagcaggaacattgttgtggtggaaaaggactctctggtga

SEQ ID NO: 614 - DNA, 1176 bp, Homo sapiens
gataaattgtactagtaagcaaaatctttgatgaatgagagggaatgactgatctggacgcaagtggatgacagcaacaaggagggggaggatacaaaagaaacagtatttacaggagagtaaggaagtagtatttgtgaaaggactaaagggaattacggggatgttctcttgtcttctttctgtccaatagtcctagcaagcatcttgctgaggcttaacctgggatcaaagaccatgaacccccagaaaccaggcagaattctgtgtacatttttctgggagcaggcccatgagtaggactggcaggtgagtcagtgtcctagggggagagttaaggcagaagtggactagtccctcaacttctgaaaaaaattatttggtcataccaaactcttgtcatgatttgttggcagaatttgtcttgtttttgcctactcaaattttcaaactaatttctcctattttaaaatgaaaatccatatttgctcttattttagcaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgaggtaagttgtctactttatattatcaggatactttgacacctttgaattttcattcacaggtaactgttaaggatggggaatttaaaaacctggttatggagcctaatggcttggatttcagtcctggctctacaacttactcactgtgtgactttaggcaagttactgaaaccttcctgtgtttcattgtctataaaatgaggacacaactaccacctgtggtactgaggtgtgaatgagattgtaattataaagcccttagaacagtgcctggcacatagaaagctctcagtaggcattttgttatacttataatgtgttaccaaaaaatatttatacaaatctgaatgtatcatgctctttggaagcgaatatcggaattttaaatatcagaatttttatttcttttataatatatttataaagcaagaataatcatatatttatagaaaaagatacaaccgtattcagaatactgtattttatgtttttttctcatt

SEQ ID NO: 615 - DNA, 1238 bp, Homo sapiens
tactttgacacctttgaattttcattcacaggtaactgttaaggatggggaatttaaaaacctggttatggagcctaatggcttggatttcagtcctggctctacaacttactcactgtgtgactttaggcaagttactgaaaccttcctgtgtttcattgtctataaaatgaggacacaactaccacctgtggtactgaggtgtgaatgagattgtaattataaagcccttagaacagtgcctggcacatagaaagctctcagtaggcattttgttatacttataatgtgttaccaaaaaatatttatacaaatctgaatgtatcatgctctttggaagcgaatatcggaattttaaatatcagaatttttatttcttttataatatatttataaagcaagaataatcatatatttatagaaaaagatacaaccgtattcagaatactgtattttatgtttttttctcattggtgatataatttattttcttaaaatagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggtaagaatgggatttaccttcactgtacatgtagcagcacattgtaaaaggtacccatctcatgcctgggcagatggtagttactcagtaaggactctgagctggtatgccctgtcttatatcacttctatgataagaagattcaattattttgtttaaagataagcttgtttcctgtctttttttctttttcttttttttttctgagacagagtctctctctgtcacctaagctggagtgcagtggcatgatcttggctcattgcaacctccacctcccagaagcgattcccatgcctcagcctcttcagtagctgggattacaggcatgtaccaccacgcccagctaatttttgtaatttttagtagagatggagtttcaccatgttggccaggctaatctcgagctcctggcctcaaagtgattggcccacctcggcctcccaaagtgctgggatcacaggtgtgagcaccgtgcatagccagtaagcttatttctt

SEQ ID NO: 616 - DNA, 1190 bp, Homo sapiens
ggatcccacgtagcatctagttgttatttctccttaggctcctgcagtctgtaacaatctgtctttatctttcatgaccttaacacttttggtcaatatgaccagttcattagtagaatatttctcagtttgacaaacaccacagtaataattattgcaagcaagatctgtcagtggatactaaaatcagtaggcagaaagttgagaagcaagatatttacatagtctcaacatttctctcctaagatacttgttaattacaaagactaaaacagtaactttacagtggagaaacctggccaacaccatctaagccaagtgaataaggattaacatcatcagtaataagacatattgatatcatgattccatatccactgatatgataccctgaaaagaacacaatgtcacttctgtggtattcttcctaaaaatacataacctcagtctaactgtgagaaacatcagatactttatttttaattgtgttttctatttaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccaggtaagtttattgtagtttaaggcagaataaaacttgttccatggtggcttgaatttgaagtgtgagagttaaaaatagtagctagtattcaggtacaggttgtgtttagaattccccatcctgaatttcagataccctcagggagaaactgcttagtttacatccctgggtttaaactttttaattcataaatttaaaaattaagacagttctgtttgtttttcatctttagtcagcttccttttgtttacatcatttgaattgctgataattaatttcacttttatcctattaaactttgctaaaattgtatctagaaatggtttataagtttagatttaaaaaataaatgataagagcaattaatttttaaagattttgaataatgcagtaagtttattaaaggaaatcattttgttatattcttaagatggaacttaaagatgttgaaagaaaaattgcacaacaagcagctaagctacaaggaatagacttagatc

SEQ ID NO: 617 - DNA, 1127 bp, Homo sapiens
tacaataatgcctgaagaagaaagtgccaaagtatgcctgacagatgttacaattatggagaggttccaggtaagtttattgtagtttaaggcagaataaaacttgttccatggtggcttgaatttgaagtgtgagagttaaaaatagtagctagtattcaggtacaggttgtgtttagaattccccatcctgaatttcagataccctcagggagaaactgcttagtttacatccctgggtttaaactttttaattcataaatttaaaaattaagacagttctgtttgtttttcatctttagtcagcttccttttgtttacatcatttgaattgctgataattaatttcacttttatcctattaaactttgctaaaattgtatctagaaatggtttataagtttagatttaaaaaataaatgataagagcaattaatttttaaagattttgaataatgcagtaagtttattaaaggaaatcattttgttatattcttaagatggaacttaaagatgttgaaagaaaaattgcacaacaagcagctaagctacaaggaatagacttagatcgaactgtccaacaagtcaaccaggagaaacaagagaaacagcacaagttagacacaggtaatacagtctgtgtccttctgtactcatagagactttgacattgcgagcacatgccttttacagtcaattttatatctgttacatggacaacgaagttccttcctgtccacatatatttgctctttttttctgaaaagcatcacttctctttgttctcttactttgcacaacagattttgaacagtaggagagtatgaaataagctgtattctcttttccttttttttttttttaagatagagtttcacttttgtcgcccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccacctgcctcagtctcccaaagtgctgggattacaagt

SEQ ID NO: 618 - DNA, 1194 bp, Homo sapiens
cccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccacctgcctcagtctcccaaagtgctgggattacaagtgtgagccagtgcgcctggccatgagctgtattctttctcattcatacctgccctgtaagctttccctgtgagtggccagcagggaacatcaagctgatttgagaactagcagggttctcattgtatttttgttgcagtgggtggggcccacagaaatagcatttgtggattccatagaccgataaaaatgggaagaatgatacaaatagtattttctatgcccttacattaattactgtgataatatgtttttgtgtagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggtaagaatatccatacatgttttttgtaaaattattttaattatttatttttatttttattttttgagacagtctcgttctgtcacccaggctggagtgcagtagcacgatctcggctcactgcaacctccatctcctgggttcaagtgattctcttgcctcagcctctggagtagctgggattacaggcgtgcaccaccatgcctggctaatttttgttcttttagtagagacgggttttcgccattggacaagctggtttcaaactcctgaactaaggtgatccgcctaccttggcctcccaaagtgctgggattacaggcgtgagccagcatgccccgccccattcttctcttttagagacagagtcttcatcagtcttccaagctggaatgcagtggtacagtcacagctcactcactgcagcctcgacctcctgagctcaagcaatcctcctgcctcagcctctcaagtagatgggactacaggcacacaccacc

SEQ ID NO: 619 - DNA, 1111 bp, Homo sapiens
gctaagcttaaggacagaagtgtttttaccatcatgttttcatctgaaaaagaaaagtctggactgaatgagctttcctattctttgatcatgcagcagtgacgggcacctataaaatcatgaaaactcatgcttgaagccacacgctaatataattgggagcacatggcctagattaagaatcaaattagtggttgatgcagtatagcatgcgtagtggttaagagcgtgaactctggagctggactgggttaaaatcttggctgcttcatttactggctgttgtgaccctggacaaatcattctctgtgtctgtttgctcgtttgaaatataggactgaaaatgatggtactgtcctcatagggtcattgaaaggagcaaatgagttgacttttagagcctggcacatagaaagtgcttttattaagactgtgaagtctgacccctaaagtaagataatggaatattatataatactttatcttttttatatttttaggatgctaaagagcaggtaagccctttggaaacaacattggaaaagttccagcaagaaaaagaagaattaatcaacaaaaaaaatacaagcaacaaaatagcacaggataaagtaagatttcatttatatatttacttatcaaatatctgtattaaacttatgttcatagcaccacgtcggacacttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaa

SEQ ID NO: 620 - DNA, 1093 bp, Homo sapiens
tgctaaagagcaggtaagccctttggaaacaacattggaaaagttccagcaagaaaaagaagaattaatcaacaaaaaaaatacaagcaacaaaatagcacaggataaagtaagatttcatttatatatttacttatcaaatatctgtattaaacttatgttcatagcaccacgtcggacacttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaaaattatttatttgattgtatttttattcatgtgcttaaagaattttcttttttgtagcaaaaagaaactgaacttaataaagtaatagctcaactaagtgaatgcgagaaacacaaagaaaagataaatgaagatatgagactcatgagacaagatattgatacacagaaggtaggtctgttttgcttatgatatcacttacacctatgacattcttttctatagttttattttcaatagaagatccattgaatagaaatgcaaaaaggaaagaggccaagcgtggtggctcacacctgtaatccctgcactttggaaggccgaggcgggtggatcacttgaggccaggagatcaagaccagcctggccaacacagtgaaaccctgtctgtactgaaaatacaaaaattagctggccgtggcggcgcgcacctgtagtcccagctactcgggaagctgaggcatgagaatcacctgaacctggg

SEQ ID NO: 621 - DNA, 1114 bp, Homo sapiens
gcaccacgtcggacacttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaaaattatttatttgattgtatttttattcatgtgcttaaagaattttcttttttgtagcaaaaagaaactgaacttaataaagtaatagctcaactaagtgaatgcgagaaacacaaagaaaagataaatgaagatatgagactcatgagacaagatattgatacacagaaggtaggtctgttttgcttatgatatcacttacacctatgacattcttttctatagttttattttcaatagaagatccattgaatagaaatgcaaaaaggaaagaggccaagcgtggtggctcacacctgtaatccctgcactttggaaggccgaggcgggtggatcacttgaggccaggagatcaagaccagcctggccaacacagtgaaaccctgtctgtactgaaaatacaaaaattagctggccgtggcggcgcgcacctgtagtcccagctactcgggaagctgaggcatgagaatcacctgaacctgggaggcagaggttgcagtgagctgtgattgtaccactgcactctagcctgggcgacacagcgagactctgtctctaaaaagaaatgcaaaaagtaaagaaaaataattccaataacattcttacttcatttattttttatttttattttcagtaaaagactcatggtaaaagttcgaacataaaggcat

SEQ ID NO: 622 - DNA, 1128 bp, Homo sapiens
aaaagttggggaagacttcagtagtagtattgatctcttataatctttcaggtcagtaggctttatcatggggttcctatgcaaaatgatccactggggatgtaggtattaaaatatctagttatatttttaatttcaccatttaaaatgtctgttttgtatgtttttaatactttataagtaaataagtacacagatatatgctcaaatctttatgagactccccatcaaacagtagacctggtttttagattatggttgtgaaagagcagtaaaagctgcgctacaggaggtattacacttgtcactgtggatggggatgggccatccagattgccccagacctgtagattccttcacactggcttattctccctctgttgaatttcacatgattctaagtaagacagaaatggcacttgctgtcaccagttgcctgttacagatttcatgttagtaacttggttatttttgttaactaatttaatgtttacctttagatacaagaaaggtggctacaagataaccttactttaagaaaaagaaatgaggaactaaaagaagttgaagaagaaagaaaacaacatttgaaggaaatgggtcaaatgcaggttttgcaaatgaaaaggtatgcttttaaaataatcttcagtttaaataaacgtctttattactggaatgtgaagaatattaaatacctgttttaaaagaattttagcctcagcctggtatcctttgagagttactagaaggtgaacagtgttttgatacaattatatttcatggccttaagaactttattactgaagaagtgatatagaattggtaatcacactgtagtgatgggccttagttattcagtattgaacatgcttagcccccatacatctgctagcctgctgcacagaatagtggtactaagcataaagaatatggagctgtggaccttgtctgggtcagagcttgtacagtctataatattgtcaatggagttgttgccagagtgatttatccacagagattcattttagattttctcatttgtaattatgtgtccaccagagcatttcttttgaaagatgagcctcattcttcctttatctggtcttattgttacttattgtagtt

SEQ ID NO: 623 - DNA, 1225 bp, Homo sapiens
caagagaaattttgttttcatggaggaatctaaatttttaataagtattactgcagaaaattaatatatgatttaattcgtattgtgcctttgacatgagcaaaatgatgatgaagcctgttatccataacttcttagtgttgataattgtgcattctcagttcacaatcagaagattgtgaatttgtaatattaatcaccagagtgctttacttagcgtctaaaggccaggaactttatcagtgatcacatgctatgagggttctgtaatacacaaaattagctatttagcaacctatgtgcggcagagatatggaaggaagagaggggttttctttagtaccaaagccctaaataataagcaaggagagactctgttataatatactgattgctaaggagaatgatacttaacctatctaaagaaatctatgacttttccacttcaggttgttaaaagctaaaaaatggtcctcatttgtcatttttcttttttacagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccagtaagtattagactggggattttcttattgcagttaatattaactaacatactttagtcatcttttctctcatttttttctttttttcttttttattttttgagacagagtttcactcttgtttcccaggctggagtgcaatggcacgatctcagctcactgcaacctctgcctcccgggttcaaatgattctcctgcctcatcctcccaagtagctggtattacaggtgcatgccaccacgctgggctaatcttgtatttttagtagagacggggtttctccatgtaggtcaggctggtctcgaactcctgacctgaggtgatccacccgcctcggcctcccaaagtgctgggattacaggcatgagccactgcgcccagcccctcattttttctctttaaatatggtattttatgtataccatggattggaaaatatatgtatgtatgtatgtaaacacacactagcttaagttatgaagttaagatataaagcatat

SEQ ID NO: 624 - DNA, 1086 bp, Homo sapiens
gacaaggtggcagttcgattctcctattttccccatagactgcaggccccttggctaaccgtaaaccttctaccctttaactccctgtcgtccattcagcaggccttcctgtgacccgtgagtatcagtggaagcattccctccaataagttaccacggcctaagaaaaaagtctaaaaaattatgtttcctgaagttttcacagtatttaagtatttacgtaaaggagtatttgttgtatcctagagagtgaatatggagaagggtacccctggagcactagaaataagcctgccaattttcagtattagccaagcagcaaagttttgctgctgtttatttttgtagctcttactatattctacttttaccattgaaaatattgaggaagttatttatatttctattttttatatattatatattttatgtattttaatattactattacacataattattttttatatatatgaagtaccaatgacttccttttccagagcaataatgaaatttcacagtatgaaaatggaagaaatcaataaaattatacgtgacctgtggcgaagtacctatcgtggacaaggtgagtaccatggtgtatcacaaatgctctttccaaagccctctccgcagctcttccccttatgacctctcatcatgccagcattacctccctggacccctttctaagcatgtctttgagattttctaagaattcttatcttggcaacatcttgtagcaagaaaatgtaaagttttctgttccagagcctaacaggacttacatatttgactgcagtaggcattatatttagctgatgacataataggttctgtcatagtgtagatagggataagccaaaatgcaataagaaaaaccatccagaggaaactcttttttttttctttttcttttttttttttccagatggagtctcgcacttctctgtcacccgggctggagcgcagtggtgcaatcttggctcactgcaacctccacctcctgggttcaggtgattctcccacctcagcctcccgagtagtagctggaattacaggtgcgcgctcccacacctggctaat

SEQ ID NO: 625 - DNA, 1143 bp, Homo sapiens
gcgcagtggtgcaatcttggctcactgcaacctccacctcctgggttcaggtgattctcccacctcagcctcccgagtagtagctggaattacaggtgcgcgctcccacacctggctaattttttgtattcttagtagagatggggtttcaccatgttggccaggctggtctcaaactcctgccctcaggtgatctgcccaccttggcctcccagtgttgggtttacaggcgtgagccaccgcgcctggcctggaggaaactcttaacagggaaactaagaaagagttgaggctgaggaactggggcatctgggttgcttctggccagaccaccaggctcttgaatcctcccagccagagaaagagtttccacaccagccattgttttcctctggtaatgtcagcctcatctgttgttcctaggcttacttgatatgtttgtaaatgacaaaaggctacagagcataggttcctctaaaatattcttcttcctgtgtcagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggcaggtatctcaaaagcctggggagccaactcacccaagtaactgaaagagagaaacaaacatcagtgcagtggaagcacccaaggctacacctgaatggtgggaagctctttgctgctatataaaatgaatcaggctcagctactattattacactctcctgaagctaaccaacatttcctgcaacattatgtagacttttaaaagaagggcctgaagcattctcacaggataggctaaatgtagaacaagaagctgaagacccgttagagttttcatggcactccttatcagaataaggtcactgtctcatcagttataagacataccactattttatgtgccagcaggaatgaaaaaatgcaattataaccataagatgtttcagaatcaatgacataatagtattgcaaaccagattctagcttaagctagaatgaatattccagtatagtaaggagtctcattaagaaagtagcccctcatagaactaagtccct

SEQ ID NO: 626 - DNA, 1134 bp, Homo sapiens
cttttttattctctcagtctcaggattatacacaagaatatggaaatttaaaggtagcagagaaaaagtgagaggctctagaaaacgtgtcgaagttttctaacagatcccattatcaggcaaatagccaggtcaagaatttttaaggttgctcatcttacaggattattaaaattacagataaatggcattgtctctgtttctagcctttggtctcaagttggttgtagctgatgtaattttttatgtgagagcatcagcgttgttctgagcattttgttttgtggtgaatgataggctgagatcatgcaggttctccttctggaggacataagaatctggtcccagtgctgggctctcccagagggcagtgctttacctaacagtgaacctgtgacgtttcccacttttccctgctgaaaagatcatgtcaggactgcttgcctgccatgagatgagaaggtctgtgctgggcttctcacataggggcttttttccaggtattagcctcactcatcattcgcctggccctggctgaaacgttctgcctcaactgtggcatcattgccttggatgagccaacaacaaatcttgaccgagaaaacattgaatctcttgcacatgctctggttgagtaagtatctcttgcacatgctctggttgagtaagtatctcacatttggggacaggttgtgatagttcttcaaaaccaagagagttctgtgatgaaaacgttctctagctgtgttccccacttcttggggaagccagttggtgccaggccctgggctttaccttttgatagtaattcttcagatccctcctaaaggaactagatggtgaacagcagccccagacacatcctgcagctccccaagtgtgttcacagggagagagtcactgtgaggggttcctggcctggttttcctgtaaacctaccagaggaacccacatgtcatgcacagcaattagcatgccctgctaagacatctgcaggtagtggtagtgggtttaggactgtctccccagctttccacatgtgtcagagaactgtgaggaatgacagagctcttactcaaaaagcttatttgagattaggtaaagtccagtgagggtaaaattgcacacctttta

SEQ ID NO: 627 - DNA, 3444 bp, Homo sapiens
ctagtgactggtggtggcagaattctaagtagacccagctcttaagaaagcagtgttattccccttacctgtagtttgtctttattacttttaaatttttcttccagagaaaagtagtaacaggtcaggaaaatcccaggcgaaggagtaagccttctatagttgaacagtttggatattaaggaaaactcaataaaatatttatacctgctttagtgagaacttctgatctggaagaaactagttcttgtattcctgtgagtccctaagccagacctaagtgaggagtcaggccatgtgtccctactgtctggagaggagaagagactcctgcctggctggcctgaaggcctggggccacccctccacttcctgcagggtagctggggccctgacacacagcacaagttcatgtgtctgacaaggtttgcggtgacttttcaaatcaaagaaggggttatgctctttactaataatatgttctgaatatattgttgcaggataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccc

SEQ ID NO: 628 - DNA, 1500 bp, Homo sapiens
aggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattgggga

SEQ ID NO: 629 - DNA, 1281 bp, Homo sapiens
gtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatga

SEQ ID NO: 630 - DNA, 592 bp, Homo sapiens
gtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttaca

SEQ ID NO: 631 - DNA, 1500 bp, Homo sapiens
ggttgcagtgagccgacatcgtgccactgcactccatcatgggcaacacagtgagactctgtctcaaaaaaaaaaaaaaaaaaatcgccaataggtagggaataagttaccccctgctaaataagttacactcacctaggcaaggaaggaactcataaaccaccttctaaactgcttgccttcctccccgaagttctgtaatttagaggcggtcactaccactgcttgaacaccccttcccaagtctgtaccacaaaaggagctcttgtgtagcccagcccctccttctcaggaccccaggagcccagacacactaatggggacattagttgcttacttttccagctactgcttaagctaggcaggccatgaagaaataacggtctcagtaacctccatgctcgggatacgactcccgggaagacgtgggtgggtgcggggaatgcggactgatccctcccagcggccgttgggggctggcccacaatccctcgcgagggcgggaaaagcaatgtggtcgttgcggggggggggggtcagaaaagggggacggtcagcgggaagagccaagagactgcaactctacaaagagcacgcagattaattctaatgattgttccctgagcttttcacaccaaaataatggtaactggctagtgtgtgcccgttacgctcactactcccactcgagatcattcctattaatgactctgaggcttcacctaacaggccacggtggaggcaaggaaatgtggcgtggagaacccactgggcctggctctccgtcctatggtctccgtccatcgttttacagtcagggtgtacatttgatgaggaatctctaaatgggattttggggaatcaaaacggaatggtgcataagtgtgaaaatttacaagactgcgcaaagctgcaaggcccggagccccgtgcggccaggccgcagagccggccccttccgctttacgtctgacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactga

SEQ ID NO: 632 - DNA, 1187 bp, Homo sapiens
cgggaaaagcaatgtggtcgttgcggggggggggggtcagaaaagggggacggtcagcgggaagagccaagagactgcaactctacaaagagcacgcagattaattctaatgattgttccctgagcttttcacaccaaaataatggtaactggctagtgtgtgcccgttacgctcactactcccactcgagatcattcctattaatgactctgaggcttcacctaacaggccacggtggaggcaaggaaatgtggcgtggagaacccactgggcctggctctccgtcctatggtctccgtccatcgttttacagtcagggtgtacatttgatgaggaatctctaaatgggattttggggaatcaaaacggaatggtgcataagtgtgaaaatttacaagactgcgcaaagctgcaaggcccggagccccgtgcggccaggccgcagagccggccccttccgctttacgtctgacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgag

SEQ ID NO: 633 - DNA, 1404 bp, Homo sapiens
taattctttatgtgatgactaagaaaacgaatacctttattaagctgaatttttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctga

SEQ ID NO: 634 - DNA, 1500 bp, Homo sapiens
tcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctagtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctg

SEQ ID NO: 635 - DNA, 2402 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacaga

SEQ ID NO: 636 - DNA, 2082 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaaaaaaaaaaaaaaaa

SEQ ID NO: 637 - DNA, 2462 bp, Homo sapiens
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacaga

SEQ ID NO: 638 - DNA, 1500 bp, Homo sapiens
atgtggatgtgaagtccagccctgtgccgcctagctgggtgacctttggcaagtgatttaacctcactgaacctcagtttcttcattggtgaaacagggataaaaaatagcgcctccctcacagatttgtgatgagataaccatgtaaagttttatttcttcctatggatgaggcaaagcaaaggacatttaaaaataccaaatcatatctttttgtgtgtgttctatataaccaaggtttcttgcccttaaaaaaaataaaaaataaaataaaaaatagaggccgggcacggtggctcacacctgtaatccccgcacttcgggagaccaaggcaggaggattgtttgagcccagtagttcgagacctgtgtgggcaacatggtgtaaccccattttgtagaggcgaaacctctacaaaaaatacaaaaattagctgggcaaggtggcacgtgactgtagtcccagctactcaggaggctgaggcaggaggatcgcttgaacccaggaggtcgaggctgcaaagctgagatctcaccagggcactccagcctgggcggccgatcgagaccctgtctcaaccaaaacaaaacaaacttttgaaaaatagacgcaggtgccctctggatgctttgctgcttcttgacacctgtcgtataatctgtaatgatgtgatttctgcgattccttttcattgtctgtctttcccttgctcacagtaagctccctgggggtaagggcgggtcgtcttgtgtcgcattttgtctccagcggagatccgttccgtttggaacggaagctggcgcacagaaggctctttagaaggtcggtgtgtgtgttgcggcagaaggtagaggccgaatgtggccgcgggtggcgtgttgagcgcggagggggtcgtgggactcgggaacctgtgcaggcggtggagaggggcgcagcggctctgccccgtgcggcccgcagatggcgctgcaggccaggtcctcgccgcgcgccagcctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagcc

SEQ ID NO: 639 - DNA, 1338 bp, Homo sapiens
acccaggaggtcgaggctgcaaagctgagatctcaccagggcactccagcctgggcggccgatcgagaccctgtctcaaccaaaacaaaacaaacttttgaaaaatagacgcaggtgccctctggatgctttgctgcttcttgacacctgtcgtataatctgtaatgatgtgatttctgcgattccttttcattgtctgtctttcccttgctcacagtaagctccctgggggtaagggcgggtcgtcttgtgtcgcattttgtctccagcggagatccgttccgtttggaacggaagctggcgcacagaaggctctttagaaggtcggtgtgtgtgttgcggcagaaggtagaggccgaatgtggccgcgggtggcgtgttgagcgcggagggggtcgtgggactcgggaacctgtgcaggcggtggagaggggcgcagcggctctgccccgtgcggcccgcagatggcgctgcaggccaggtcctcgccgcgcgccagcctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagccaagctctaaaacagggtagagattcctactgtgtgcagggcaccgcgccggctcctgcagctttgttatttcacactggcctcctgagacggcctgccggggggtagaattgacaccccatttgacagatgaggaaaaaccaagtgtgggaggccccagtcctctctgccaatccgctatacgtgttttgttttcagtggtggacctggtttctgcagacctggaagaggtagctcagaaatgtggcttgtcttacaaggtgagctcctgatctccacattccaaacctgagtgtctttttaaaaagtccatcccaagccagctgggcgcggtggctc

SEQ ID NO: 640 - DNA, 1062 bp, Homo sapiens
ccccgcgaatgcccacgtgacgtgcagtccccctggggctgttccggcctgcggggaacatgggcgtgctcagggtcggactgtgccctggccttaccgaggagatgatccagcttctcaggagccacaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagccaagctctaaaacagggtagagattcctactgtgtgcagggcaccgcgccggctcctgcagctttgttatttcacactggcctcctgagacggcctgccggggggtagaattgacaccccatttgacagatgaggaaaaaccaagtgtgggaggccccagtcctctctgccaatccgctatacgtgttttgttttcagtggtggacctggtttctgcagacctggaagaggtagctcagaaatgtggcttgtcttacaaggtgagctcctgatctccacattccaaacctgagtgtctttttaaaaagtccatcccaagccagctgggcgcggtggctcatgcctgtaatcccagcactttgggaggccgaggcgggtgggtcacttggagtcagaagtcaggagttcgagaccatccaggccaacatggtgaaaccctgtccctactaaaaatacaaaaattagctgggtgtggtggcccacgcctacaatcccagctactcgggaggctgaggaaggagaatcatttgagcccgggaggcagaggttgcagtgagccgagatcgtgctactgcactccaatctgggcgacagagtgagaccctgtctgaaacaacaacaataacaaaagtccatcccaagccaaagggagcagagggttctcagatattgagaagtagggtgaatgacaccctgggatgccagcttctacgggcaatttgttgctgagcagtctggggccctttggcaggccctggtt

SEQ ID NO: 641 - DNA, 1179 bp, Homo sapiens
agccttggtggcagagcgagactctctcaaaaaaaaggagcagttatgtcccgccacgttgtttggtgggttggggaagagttgcaaagacgacagacgtttgctggccaagtgagtcttgacctttttcctggtctgtttgttcagaaattgatgaataactgccaccataaaggtctttggattggtgtggccctttctgtttccttaacacattctcttggcagggttcatgcagtgtggtgcttgctttccctggttgggggtctgagtctgtgatccatcaagcactggctaagggcctgctgggtgcttggtatgtgcagatgatacatacacgaatgaggcaaggcccctgcccttaaggcctctagttgggtgtaggggaaaatcaagtgaatacaagagagctgtaagcaccgagggaggcaacggtaaggagggagtggtgaacaggaagccgattggccttgggcttagggagtttataaatccaacagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggtacattatttcatttattcgtcacaaccaccaatgagcatgttactgtttaaatcatcattctaggccgggcgcagtggctcacgcctgtgatcacagcactttgggaggctgaggtgggcggatcatgaggtcaggaaatcgagactgtcctggctaacacggtaaaaccccgtctctactaaaagtacaaaatattagctgggcgtggtggcgggcgcctgtagtcccagctactcggaaggctgaggcaggagaatagcatgaacccgggaagcggagcttgcagtgagcggagatcgcaccactgcactccagcctgggcaacagggcaagactccatctcaaaaaaataaaataaaataaaataaaataaaaataaatcatcattctataggtgaagaaattgggactcaggttaaatgacttgttcaagattgtgcagttagcaaacggcagaccagttatttgagttcatgcttgtcacactcctaagtcta

SEQ ID NO: 642 - DNA, 1119 bp, Homo sapiens
tcttacaaggtgagctcctgatctccacattccaaacctgagtgtctttttaaaaagtccatcccaagccagctgggcgcggtggctcatgcctgtaatcccagcactttgggaggccgaggcgggtgggtcacttggagtcagaagtcaggagttcgagaccatccaggccaacatggtgaaaccctgtccctactaaaaatacaaaaattagctgggtgtggtggcccacgcctacaatcccagctactcgggaggctgaggaaggagaatcatttgagcccgggaggcagaggttgcagtgagccgagatcgtgctactgcactccaatctgggcgacagagtgagaccctgtctgaaacaacaacaataacaaaagtccatcccaagccaaagggagcagagggttctcagatattgagaagtagggtgaatgacaccctgggatgccagcttctacgggcaatttgttgctgagcagtctggggccctttggcaggccctggttgccctgaggcgggtgctgctggctcagttctcggctttccccgtgaatggcgctgatctctacgaggaactgaagacctccactgccatcctgtccactggcattggcaggtttgtgtgtgtacttggggaagaaggagagaggcaggaggatggggcctcctctcagctctgcttttgatgcttgagtctagacgggaggggttttttttttaaccaataatggatgggaaggaaaggggtcaggacatctgaattcttatcctataacagggttatggggtatctcagccttggcactattgatatttagggacaggtaattatttgttggggggtggaggctgtcctgtgcagtgtaggatgtttagcagcatctctggcctctgcccactagatgccagtagcaccagccctgctccagttgtaaccatcaaaaatgtctcctgacatggctaaatgtcccctgggaggcacaattgcctctggttgagaagcattgtcctataacacaagctgtcagtatctcattattttcaccatcttctctggccctacttcttattttacttaaggatatggcaagagagaacatttactgagtgcctact

SEQ ID NO: 643 - DNA, 1082 bp, Homo sapiens
tgaaaccccgtctctaattaaaaaaactagtcgggtatggtggcgggcacctgtagtcccagctactcgggaggctgaggcaggaaaatcacttgagcctgggaggtggaggttgcagtgagtagagatcacgccactgcactccagcactccggcctggacaacaaagagagactccgtctcaaaaaaaaaaaaaaaaaaaaaaaaaaaggaaacccacagggcctgagatgaaaaatgaagggagaaccttctgatggggtggcagaggcctctctggagagctgatctttaagagtggagggatgaagagagaccagagaaggcacatttgggcattccctccttaccagaagaaaacaccaggagaagcctcctggccagtgatgttcaaagacagaaccagtgcttgaaagaaatgtcttacttttcttcttggtaccttttcccctgtcttcctcctaacctcttgtgttgattttcttctcttctgccatcagtcttgataaactgcttgatgctggtctctatactggagaagtgactgaaattgtaggaggcccaggtagcggcaaaactcaggtacatgtgaggccagcagtcaggaggatttaggggtgagggtggtagatgcatagcccagggtccctgggggagcttcagcgtactaatgggttcagagcccaacagagagaagatgggtaataaggaatggggtcgggactcagcccatttgtgttgctggaatctgggcaaggtttggtggggagctcccatctggaccctctctgaagtgtcaagttcatccaatgcccccacccccaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggtaagggcaggatgctgggttccattgagattctgacacaggaaaaccccattatcccttaacattgtaagaatttgggttgaatagtcattccttgccttcaaacttgctgttctattaat

SEQ ID NO: 644 - DNA, 1135 bp, Homo sapiens
gcacatttgggcattccctccttaccagaagaaaacaccaggagaagcctcctggccagtgatgttcaaagacagaaccagtgcttgaaagaaatgtcttacttttcttcttggtaccttttcccctgtcttcctcctaacctcttgtgttgattttcttctcttctgccatcagtcttgataaactgcttgatgctggtctctatactggagaagtgactgaaattgtaggaggcccaggtagcggcaaaactcaggtacatgtgaggccagcagtcaggaggatttaggggtgagggtggtagatgcatagcccagggtccctgggggagcttcagcgtactaatgggttcagagcccaacagagagaagatgggtaataaggaatggggtcgggactcagcccatttgtgttgctggaatctgggcaaggtttggtggggagctcccatctggaccctctctgaagtgtcaagttcatccaatgcccccacccccaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggtaagggcaggatgctgggttccattgagattctgacacaggaaaaccccattatcccttaacattgtaagaatttgggttgaatagtcattccttgccttcaaacttgctgttctattaatacatctcgtattccttaagccacccctgttgatgccatcatcccatttgggatgctactcacactgattcttccaggaaaccctcccaactctttgcatgccctaaaccagggctggcaaacaccaagctttgtgtttccagtccatttctcacctgtgagagacatcactaatcagtcatatccctctttcctgctgagttctgagtactttacagctcagcacccaggcagccaccactgtgacaactgaccattagacaaagctcatttgccaccctggacctgagtccttgcatccaggtgcctcttccttctcagccttaccttgacccccctactccctcttatccaaagtccttgcttttcttttccaccg

SEQ ID NO: 645 - DNA, 1096 bp, Homo sapiens
gcaggatgctgggttccattgagattctgacacaggaaaaccccattatcccttaacattgtaagaatttgggttgaatagtcattccttgccttcaaacttgctgttctattaatacatctcgtattccttaagccacccctgttgatgccatcatcccatttgggatgctactcacactgattcttccaggaaaccctcccaactctttgcatgccctaaaccagggctggcaaacaccaagctttgtgtttccagtccatttctcacctgtgagagacatcactaatcagtcatatccctctttcctgctgagttctgagtactttacagctcagcacccaggcagccaccactgtgacaactgaccattagacaaagctcatttgccaccctggacctgagtccttgcatccaggtgcctcttccttctcagccttaccttgacccccctactccctcttatccaaagtccttgcttttcttttccaccgcttcaggcagaagctctccggaggatccaggtggtgcatgcatttgacatcttccagatgctggatgtgctgcaggagctccgaggcactgtggcccagcaggtgagcctgctgttctgcccctccttgcttaattcagctttctaggtgctatctctgtgggcaggtgtcctactacagactgtttggaaatgcagatgtgcaatctggtgactccaactatgcttgctactcccaggatggaattcccgagcacctaaatcacatacctcattgtttacatgttcatcttccctgctgaacagtaaagccccctgagtggaaggatcatgtcatatttatgtctgcattccccactaggtgagtgaggaatacttttagctgcaagtaatagaggttgtctgacagagacttgaagcttgaggacatttaattatgtcacatgagttgggaggttggcaggtccatgctatcagggcaatagatttgtgtgtctgattttcttgttcttcccctcatggttgcaaagaggctgccaaagctccaagcatcttgtcttcacacatccacatccatattcaaggcagtaaaagatagatggt

SEQ ID NO: 646 - DNA, 1091 bp, Homo sapiens
atgcagcggtgtgatctcagttcactgcaacccccgcctcccagtttcaagcgattctcctgcctcagcctcctgagtagctgggattacaggtgtgcaccaccacgcccagctaatttttgtatgtttagtggagacggggtttcaccatgttggccaggctggtctcgaactcctgacctcaagtgatccaccgccttggcctcccaaagtgctgggattacaggcgtgagccactgcgcccagccactttagtgtagttttgatgtcctgtgatttaaaccctttctttctacccaagtcttcattgaagtctgttacacatgccaatgggacgagggagacattgctgctgatgacattctgtgatgcccgtgcagcttgctgtatttgggatgggggggctatttcttactagttttagatagaaaagcaagcttgtcctgtaatgtgtcctagaggctgacaggttcatgagtgcttcccccacattccttcaggtgactggttcttcaggaactgtgaaggtggtggttgtggactcggtcactgcggtggtttccccacttctgggaggtcagcagagggaaggtgagtgatgtggcagagcctggggccagtggaatgtgacctcgcctcccagctctggagtctggtctctggccagccccatccctggttccccactgccctccctctctgcttctcctcctcctgcaggcttggccttgatgatgcagctggcccgagagctgaagaccctggcccgggaccttggcatggcagtggtggtgaggaagcaggcttggccaatgaacttgatttctagttattgcgagctctttatttcccttaaatgtcagcttctgaaccccaaagtggccctttaggaaagggacatatcccagcttccctgggtcagctacagctttgcaccataaatagctaagggaatcaggaatcgtcttgttgtttttttgttgttttgttttgtttctacattttttctttttagtcaggtttattgaggtataatttacatagagtaactttctccttgtttgaagtttgactaatggatatagttgtat

SEQ ID NO: 647 - DNA, 1071 bp, Homo sapiens
ttacaggcgtgagccactgcgcccagccactttagtgtagttttgatgtcctgtgatttaaaccctttctttctacccaagtcttcattgaagtctgttacacatgccaatgggacgagggagacattgctgctgatgacattctgtgatgcccgtgcagcttgctgtatttgggatgggggggctatttcttactagttttagatagaaaagcaagcttgtcctgtaatgtgtcctagaggctgacaggttcatgagtgcttcccccacattccttcaggtgactggttcttcaggaactgtgaaggtggtggttgtggactcggtcactgcggtggtttccccacttctgggaggtcagcagagggaaggtgagtgatgtggcagagcctggggccagtggaatgtgacctcgcctcccagctctggagtctggtctctggccagccccatccctggttccccactgccctccctctctgcttctcctcctcctgcaggcttggccttgatgatgcagctggcccgagagctgaagaccctggcccgggaccttggcatggcagtggtggtgaggaagcaggcttggccaatgaacttgatttctagttattgcgagctctttatttcccttaaatgtcagcttctgaaccccaaagtggccctttaggaaagggacatatcccagcttccctgggtcagctacagctttgcaccataaatagctaagggaatcaggaatcgtcttgttgtttttttgttgttttgttttgtttctacattttttctttttagtcaggtttattgaggtataatttacatagagtaactttctccttgtttgaagtttgactaatggatatagttgtatccagtcttgtgaccccaccaaaaggtcccccaggcccaggcaaccactgatctgttttccatcccaatagtttggccttttccagagcttcatataaatggatctttttgctattgaagtaactttttctgcttatgaggtagtttttttaaagtctgcatgcttctcatagaaaggatagaaaataaatatgattcaaa

SEQ ID NO: 648 - DNA, 1165 bp, Homo sapiens
ctgtatctatgctttttgactactctaggaacctcatatacatggaatcatatggtatttactttttgtgactggagtatttcacttagcataatgtccagaaggttcatccaccttgtagcatgtgtcagactttccttccttttaaaggctgagtgtctgggcgtggtggcccacacttgtaatcccagcactttgggaggctgaggctggcggactgcatgagctcaagagtttgagaccagcctggaaagcatggtgacatgtgccccatcgccttctggttcgggtcaaacctgaggcatcgagatttagtggaaagagcggggcacaagtcaggaggcccaggttctagttccagacctgccattaggttttgtaaccttggggaagttatttctctgtgctaggcctctgttttcctctccgtaaaatgaagcggtagtaatcgatgtcctctatactagcattatggatctgtaagtctgtttctgctgcaggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacaggtgagccagccccaggaagatgccagtaatcttgggccctggagggtggtttccatacccacagatgtcttcgagaagaactctttagaggctgaaaccttgcaactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgt

SEQ ID NO: 649 - DNA, 2245 bp, Homo sapiens
cacaagtcaggaggcccaggttctagttccagacctgccattaggttttgtaaccttggggaagttatttctctgtgctaggcctctgttttcctctccgtaaaatgaagcggtagtaatcgatgtcctctatactagcattatggatctgtaagtctgtttctgctgcaggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacaggtgagccagccccaggaagatgccagtaatcttgggccctggagggtggtttccatacccacagatgtcttcgagaagaactctttagaggctgaaaccttgcaactaaagaagctacccacttgggttgcttaactccactgactccttacttcttcttccagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatcaggattggttactggccacatcttttaaaggaaggtcatctttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccag

SEQ ID NO: 650 - DNA, 1500 bp, Homo sapiens
gctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatcaggattggttactggccacatcttttaaaggaaggtcatctttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatg

SEQ ID NO: 651 - DNA, 5629 bp, Homo sapiens
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgatttttttttaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaaaaaaaaaaaaaa

SEQ ID NO: 652 - DNA, 4174 bp, Homo sapiens
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaatttaaaaaaaaaaaaaaa

SEQ ID NO: 653 - DNA, 1227 bp, Homo sapiens
gtttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgggatatttactactgggccacagaagctaaaccagccccagaaatatttgaaaatgaagtcatggccctgctgagagactttgctaaaaacaaaaacaaagagcagagactgcgtgccccagatcttgagtacctctttgaaaagccacgttgagctgtgctccacggcctggcatgggggttcagtctgtggatggtaactacttatgatggacgttagccttgcttccggcttcttagatgcccagctgccctaccccagaccactggtcctgcctcaagtgatggacataaccctctcctaggacatacatgtaaatgcacaatgtgactcattctcatacttttttgttcagctctgagcctcaaaagtgatttgtcagcagcgctggcatgcaggctttgcctggctgctatctctagaggcaagtctgccacgagagggcactgcaggcgaagcagttgtgcttgctcattgcctcagcccaagtgtactcaaagaaaagaggcagccagctgtgcgtgctgtatggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgagggccacaggcaggagtggtgtgggcacactgcttaggagtcaacatcttcatcattgggctttctttaaaacgtgcactttgtaatttgaaagagaattattaaagcatactgaaaaaaggaaatttacaatttcccagccctcacaattaattttaaaaaaaaaa

SEQ ID NO: 654 - DNA, 1161 bp, Homo sapiens
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgccctctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaaaaaaaaaa

SEQ ID NO: 655 - DNA, 2858 bp, Homo sapiens
gcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 656 - DNA, 2694 bp, Homo sapiens
gcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 657 - DNA, 2756 bp, Homo sapiens
gcgtcacttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 658 - DNA, 2699 bp, Homo sapiens
gcgtcacttccgtccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 659 - DNA, 1382 bp, Homo sapiens
gtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccctgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgcttttaaaaaaaaaaaaaaaaaa

SEQ ID NO: 660 - DNA, 8770 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaacta

SEQ ID NO: 661 - DNA, 1500 bp, Homo sapiens
agaacaccagtttggagctttaggggctttctggtcaaagagggaatggcccaggcggtgatgtggaggatagaatgaagcactgagtatgagtggcgaaggcgtacggtgggtgtagagattttctgggcgacgtgacctaagaaatgactttagaactggctaatcattggttttggagggactaaaagtagttcctggttggtgaaaataaatcattaatgcgttttaaatgaaaaagaaatgcatgcgtcttgtaaaaaatgtgaaataaaagaggcataaagtcaaaagcagagcctatgccttcccccaccaaacaaacaggtaacctagttaacaggtgtgtcgtaggattcgaagttcgcctccagctccgagagtgcgcctacatctcttccaacaaaatccactcacacttgcaacgcctggcaaggctcttcaatatgtgattccttgactgtcctgtgcgtctctcgagtgtaaacacctctggggctcgtgattcggggctgccagaaagagaaggaaggtgccgccagcgtctgtttcttcccgaagtgaactcctacaacctagccaccttctccccagagctgtcgactggctgttgaaggccaatttttgtgcctacgcaggtcctcaacacagaacaaaacaaaaaaacaacaaaggccgggctaatagctatttataaacacttactggacgcccactctacgccgagctctcccgcgctccttggatacttttttgcaacgagatgccaatttccccggcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgac

SEQ ID NO: 662 - DNA, 1411 bp, Homo sapiens
cgtgattcggggctgccagaaagagaaggaaggtgccgccagcgtctgtttcttcccgaagtgaactcctacaacctagccaccttctccccagagctgtcgactggctgttgaaggccaatttttgtgcctacgcaggtcctcaacacagaacaaaacaaaaaaacaacaaaggccgggctaatagctatttataaacacttactggacgcccactctacgccgagctctcccgcgctccttggatacttttttgcaacgagatgccaatttccccggcgaccactccctcaaacaggccttcgcctccgcccgcgctgaggcccaggcccaggtccagattcagagccgcccgccggctggcgctgccctgtaggcgcctgcgcagagcgaccctccccgtcactcggagcgggaggcgggggcagccgggagaaaggaaagctgcgggggaaaagggccaaaccctgaaattacccggatgtggtccccgcgcgcgcatgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgag

SEQ ID NO: 663 - DNA, 1376 bp, Homo sapiens
ttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagag

SEQ ID NO: 664 - DNA, 1175 bp, Homo sapiens
tcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttt

SEQ ID NO: 665 - DNA, 1030 bp, Homo sapiens
acttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttac

SEQ ID NO: 666 - DNA, 1213 bp, Homo sapiens
cttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagc

SEQ ID NO: 667 - DNA, 1120 bp, Homo sapiens
tatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttctta

SEQ ID NO: 668 - DNA, 1117 bp, Homo sapiens
cgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaat

SEQ ID NO: 669 - DNA, 1051 bp, Homo sapiens
ctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgta

SEQ ID NO: 670 - DNA, 1184 bp, Homo sapiens
aaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcac

SEQ ID NO: 671 - DNA, 1169 bp, Homo sapiens
tctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggatta

SEQ ID NO: 672 - DNA, 1139 bp, Homo sapiens
tctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggt

SEQ ID NO: 673 - DNA, 7786 bp, Homo sapiens
tgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaatcattatgtgctcattctttttcttaagcttgtggatgtcttggatctggaaagggtttctgatcacttagagaattttcaaactttaggtcaacattttcctttattgccttgtggccactgaaatgggaaatgtgacatttaaaatatgaccctggaataacagtccccattcttctctcatttttaaaaggagaaggtgaagtgatggtgatcagagagatgggtgctagggaattataagaaccaggatgcttaaaggagaggtaaaattggaaattggagaccctttcattgcccagctaagggataaggaaagctgtttctctcccatctgccttctctgtgaaataggggtcaatgggaggggagtggtggtcaggtaagtagattccgtggcaatggcttgtatataacaagaccacatcagcattttatttctaagcttgctgacatgagtttcagagagtttatcgggctgagagatttcttctcacct

SEQ ID NO: 674 - DNA, 1500 bp, Homo sapiens
tttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaatcattatgtgctcattctttttcttaagcttgtggatgtcttggatctggaaagggtttctgatcacttagagaattttcaaactttaggtcaacattttcctttattgccttgtggccactgaaatgggaaatgtgacatttaaaatatgaccctggaataacagtccccattcttctctcatttttaaaaggagaaggtgaagtgatggtgatcagagagatgggtgctagggaattataagaaccaggatgcttaaaggagaggtaaaattggaaattggagaccctttcattgcccagctaagggataaggaaagctgtttctctcccatctgccttctctgtgaaataggggtcaatgggaggggagtggtggtcaggtaagtagattccgtggcaatggcttgtatataacaagaccacatcagcattttatttctaagcttgctgacatgagtttcagagagtttatcgggctgagagatttcttctcacctgtttgctaacctgaaatttatagtattttaggctagaacttgaagaggatagtaggttagcattcagttgagaaaaaggaaaaacattgtggagcacttcaggtgaaagggcagttgtgtgtctctctgccttctgctcttgacccttaattctttgtgcttaattccatctcctcccacgtcacaactctctcacaaatggcagtctcaaagcttagggaatctccatcacttcttcaaacctttcccacccctgttgtcttactgataaattgtaatgccctttctcctcagccctttgtattctaaaagaataattccattagttctggcctacttttggagtggcatccacatctatattttgatagttttgttaggccaccactaggtctcagacagatggacaagaggcgttcagggagagcagacaatccattgccagcagacctaccttaatcgagtggtagtaaaggaagttccctaagcagaaaagaaag

SEQ ID NO: 675 - DNA, 3277 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctga

SEQ ID NO: 676 - DNA, 1500 bp, Homo sapiens
agctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcc

SEQ ID NO: 677 - DNA, 2405 bp, Homo sapiens
tgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtt

SEQ ID NO: 678 - DNA, 1084 bp, Homo sapiens
ggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggacc

SEQ ID NO: 679 - DNA, 1090 bp, Homo sapiens
tttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgc

SEQ ID NO: 680 - DNA, 1133 bp, Homo sapiens
ttttggggtcccccatgtgtggcatccacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggcc

SEQ ID NO: 681 - DNA, 1137 bp, Homo sapiens
cctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctaca

SEQ ID NO: 682 - DNA, 1128 bp, Homo sapiens
accctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctacaacatcaccacgggtctgtaccccttcgaaggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagc

SEQ ID NO: 683 - DNA, 1058 bp, Homo sapiens
ggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcagggatgcttgagtacgaaccggccaagaggttctccatccggcagatccggcagcacaggtgagcggcccctgggggcagtggggccgaggctgcagggaggccggccatgtgggcagctggttgagcgggcgctagagcagggcgtggtgggggtgccaggctgggctggggccagaccccgtgcagcgcccgcagttctcggggcccgagtggggtctctgggcagtgtcctgttaccggccagacccaggcgccttgtccgaactggggtctgagtgaggacatgcgtccgtccctgccctaggcatggagatgcgccaggaagggcacagctggtcccaaacactggcgagagcctctctttttcccctcctcctggggctcccagcagcagggtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccg

SEQ ID NO: 684 - DNA, 1188 bp, Homo sapiens
gccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgtcgtccctgaggcctgcccgctggccctgatgccggccgcccttcttccctaggtggcgaggaggcgtctgaggcagggcttagagcg

SEQ ID NO: 685 - DNA, 1210 bp, Homo sapiens
gccctggcaggctgagctctgctccccgcgtggttctgtgctggcatttcgcgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcaggtggggcgcggcggggcccgggtggggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagggtgccgtctcggggcctggtgtctggccagcgtgctggtcatggaggcctacgtgtggcggggctctgggggggcgtgccgtcctcacagccacctctcagagtgggtgcattccgaggaccctgccctgggcctggcgccccctccccatgcccgcgccgcttccaggaaaggcttatgctgggctcagcccagaggcttttgagcaccagtgggtggtgggtggtggggaggggccgcggcctccatggctctgccggggtgccgcaggctctgagccagctgccaagtatggctgaggctgagtcgtgccggacgctgccctgtctctccc

SEQ ID NO: 686 - DNA, 1843 bp, Homo sapiens
gccgcaggctctgagccagctgccaagtatggctgaggctgagtcgtgccggacgctgccctgtctctccctgtgtgcctgcctcctctcccagccccagccccagccccgggtgggagacggagtcccagaggtgtcagagacccttaagtcacctgccgaggatgcggggtggatgggggcccgaggctgaagcccctgccttgccacagcccctctcccaggttttgggggccaccgcctgagttacatgtctgtcccccaaatgggtgcccacagcccatccaccagcgtcagagcccgccaggccccactgcaaaaggccacacaatgtaccccgggagtgactcaagggtggccttccctggcctcccctgctgccccccaggagtccggtagccccatgactgtacctcagcttctccatcctcccaggggcccgcgggaggcggagaaccggtgcccaggctgacctcttccgtcttccttccaccctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctggccgtctgggttttgttcgcgtctcaacgtggatggggcggcagcggggcgggcgccgttgacatgcggagggcagtggggactcggggcgcgggagggccggggccggctccctcagggccggcggcagcagcggtggcggcgcggttattgctcggaggcggcgcgggctgccgccagcacacgccgcagtgaggtaaacggtctcggaggtcggcagtcacggtgttgagccgcctcccggcccagggcggcgaactcgtctgcgaccgttagcgccccgcggcccccgcccgggcgagctcgcgcacgcgcccggcacgcggcggctccatcgggcccagtgggctgcgcgaccctcgggtggcgggccctgcgactaagcggccgccccgtccgggactgagggcgagtgatcgttgtcctcaggagcccgaagctgagagccgttcacgccccttccttcccgcccagccggggtctccgcggcccgcgcctca

SEQ ID NO: 687 - DNA, 1500 bp, Homo sapiens
cccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctggccgtctgggttttgttcgcgtctcaacgtggatggggcggcagcggggcgggcgccgttgacatgcggagggcagtggggactcggggcgcgggagggccggggccggctccctcagggccggcggcagcagcggtggcggcgcggttattgctcggaggcggcgcgggctgccgccagcacacgccgcagtgaggtaaacggtctcggaggtcggcagtcacggtgttgagccgcctcccggcccagggcggcgaactcgtctgcgaccgttagcgccccgcggcccccgcccgggcgagctcgcgcacgcgcccggcacgcggcggctccatcgggcccagtgggctgcgcgaccctcgggtggcgggccctgcgactaagcggccgccccgtccgggactgagggcgagtgatcgttgtcctcaggagcccgaagctgagagccgttcacgccccttccttcccgcccagccggggtctccgcggcccgcgcctcacgacgcccagcacccggcaagcaccggaaagagcagtgcacacttcggcggcgcgagggcggccggggctctgcgcctgcgccctgaagcggcgagcgcgcctccgtcgcccggcgcgtgcgcgaagggcccgcggtccccgcgcattcgcgtcggggcgtcgcgcccccacgtctctcccgccgccgaggccccgtgcggcgccggagaagctgccagagagatgggcccaggacgcgggacttaggccgggctgtggtcgggggacgtgggggcggcggcgaccaacgcgggagtcgccacgacgggctcggcgaggcgcggcggaaagagtctctcgtcgaggccagccgccagcttgtccagcaccgacccggatggtaggacgcacaggcccgagccggggcaccccccgccgcccggctcctcctcgatgacggggatggcggggtcgtcgccggcgccgcccagggtgcgaccgtcgggcgggccgtccacgc

SEQ ID NO: 688 - DNA, 4593 bp, Homo sapiens
agaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaa

SEQ ID NO: 689 - DNA, 4570 bp, Homo sapiens
agaggaggaggaagccggaagtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaa

SEQ ID NO: 690 - DNA, 2586 bp, Homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 691 - DNA, 2588 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 692 - DNA, 2719 bp, Homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 693 - DNA, 2646 bp, Homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 694 - DNA, 2271 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 695 - DNA, 2404 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 696 - DNA, 2331 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 697 - DNA, 1500 bp, Homo sapiens
tcctcttctgggagtaggcagaagactcccgggaggagaggcgaacagcggacgccaattcttttgaaagcactgtgttccttagcaccgcgggtcgctacgggcctcttgctgtcgcgggatttcggtccaccttccgattgggccgccgcatcccggatcagatttcgcgggcgacccacggaacccgcggagccgggacgtgaaaggttagaaggtttcccgttcccatcaagccctagggctcctcgtggctgctgggagttgtagtctgaacgcttctatcttggcgagaagcgcctacgctccccctaccgagtcccgcggtaattcttaaagcacctgcaccgcccccccgccgcctgcagagggcgcagcaggtcttgcacctcttctgcatctcattctccaggcttcagacctgtctccctcattcaaaaaatatttattatcgagctcttacttgctacccagcactgatataggcactcaggaatacaacaatgaataagatagtagaaaaattctatatcctcataaggcttacgtttccatgtactgaaagcaatgaacaaataaatcttatcagagtgataagggttgtgaaggagattaaataagatggtgtgatataaagtatctgggagaaaacgttagggtgtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccct

SEQ ID NO: 698 - DNA, 1500 bp, Homo sapiens
ccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctg

SEQ ID NO: 699 - DNA, 1174 bp, Homo sapiens
acaatgaataagatagtagaaaaattctatatcctcataaggcttacgtttccatgtactgaaagcaatgaacaaataaatcttatcagagtgataagggttgtgaaggagattaaataagatggtgtgatataaagtatctgggagaaaacgttagggtgtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaactt

SEQ ID NO: 700 - DNA, 1102 bp, Homo sapiens
tctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattct

SEQ ID NO: 701 - DNA, 1241 bp, Homo sapiens
tctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtc

SEQ ID NO: 702 - DNA, 1022 bp, Homo sapiens
ggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtc

SEQ ID NO: 703 - DNA, 1279 bp, Homo sapiens
tgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcact

SEQ ID NO: 704 - DNA, 1184 bp, Homo sapiens
catccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaacccc

SEQ ID NO: 705 - DNA, 1113 bp, Homo sapiens
cagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaagg

SEQ ID NO: 706 - DNA, 1441 bp, Homo sapiens
gtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaacccc

SEQ ID NO: 707 - DNA, 1110 bp, Homo sapiens
cagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaaggcctcccctgcttgccacaggtctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaa

SEQ ID NO: 708 - DNA, 1137 bp, Homo sapiens
ctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagt

SEQ ID NO: 709 - DNA, 1074 bp, Homo sapiens
ccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattc

SEQ ID NO: 710 - DNA, 1107 bp, Homo sapiens
gcctgaacaacatagcaagacatcatctctaaaatttaaaaaagggccgggcacagtggctcacacctgtaatcccagcactttgggaggtggaggtgggtagatcacctgacgtcaggagttggaaaccagcctggctaacatggtgaagccccatctctactaaaaacacaaaaattagccaggtgtggtagcacacgcctgtagtcccagctactcgggaggctgaggcacaagaatcacttgaaccccagaggcggagattgcaatcagccaagattgcaccattgcactcccgcctgggcaacagagtgagaccccatctcaaaataaataaataaatatttttaaaagtcagctgtataggtacttgaagtgcagtttctactaaatgcatgttgcttttgtaccgtcataaagtcaaacaattgtaacttgaaccatcttttaactcaggtactgtgtatatacttacttctccccctcctctgttgctgcagatccgtgggcgtgagcgcttcgagatgttccgagagctgaatgaggccttggaactcaaggatgcccaggctgggaaggagccaggggggagcagggctcactccaggtgagtgacctcagccccttcctggccctactcccctgccttcctaggttggaaagccataggattccattctcatcctgccttcatggtcaaaggcagctgaccccatctcattgggtcccagccctgcacagacatttttttagtcttcctccggttgaatcctataaccacattcttgcctcagtgtatccacagaacatccaaacccagggacgagtgtggatacttctttgccattctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgacc

SEQ ID NO: 711 - DNA, 1060 bp, Homo sapiens
aggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaac

SEQ ID NO: 712 - DNA, 1133 bp, Homo sapiens
agtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaac

SEQ ID NO: 713 - DNA, 2289 bp, Homo sapiens
cgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtgaacgccagtgcaggctactggggtcagcaggtgcaggggtgagtgaggaggtgctgggaagcagccacctgagtctgcaatgagtgtgggctggggggcccagtgcccgggttccgggaggggaacaaaggctggagactgggtcagtctgcgggctgcatgacaacaagggagggggtggctccattcataactcaggaaccaaccgtccctcctcccctccggccacggctggcacaaggttctctccctcccctgcttctaggactgggctgcttccccctcggcagcctctcaccaaggattacgggatttaaatgtctgatttagcaaggctgagcctccagggtggccatctgctccatcagaaagtggcaggatacctgggttcccaaggggaacaggggtgggtgctactggatggagagaggccagtgggaggcctgctagccagggtcccaggaaagtgggggcagctaaggtaagagtaggggtgtggg

SEQ ID NO: 714 - DNA, 1500 bp, Homo sapiens
tggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtgaacgccagtgcaggctactggggtcagcaggtgcaggggtgagtgaggaggtgctgggaagcagccacctgagtctgcaatgagtgtgggctggggggcccagtgcccgggttccgggaggggaacaaaggctggagactgggtcagtctgcgggctgcatgacaacaagggagggggtggctccattcataactcaggaaccaaccgtccctcctcccctccggccacggctggcacaaggttctctccctcccctgcttctaggactgggctgcttccccctcggcagcctctcaccaaggattacgggatttaaatgtctgatttagcaaggctgagcctccagggtggccatctgctccatcagaaagtggcaggatacctgggttcccaaggggaacaggggtgggtgctactggatggagagaggccagtgggaggcctgctagccagggtcccaggaaagtgggggcagctaaggtaagagtaggggtgtggggctaggtccttcccagcatcccctcatcctgggcctcatgccaggtagctgaatgaattgaagctttaaactctgccaggaaaacctttcaaagggcttcttgggatagggaggagagtcgggttgaggagctcagtactgcctgcccatgctcctcagggctgctggctcccagggaggggggctgggagcaggcaggctcttccccatcacccactgctctcttggagccagtgcttgaaggggcagtcagacatggcttgcccttcctcctccctggtggtggagatgggtgttagggtccagtgggtgctactgtccaggggggcttctggggccaccagcctgtcagctcatcaaccaggctgaaggtgcaagcaggagccccttgccttgccccaaggatcccagacagctatgaagccaccagccttcctgacctcaagaccaccttttttttttctctttcttactagggaatgccaaacactctccccagg

SEQ ID NO: 715 - DNA, 4560 bp, Homo sapiens
cctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgaacccaggaggcgaagattgcagtgagctgatatcgcaccattgtactccagcctgtgtgacagagcaatactcttgtctcaaaaaaaaaaaaaaattcaaatcagagtgaagtgaatgagacactccagttttccttctactccgaatttcaactgattttagctcctcctttcaacattcaacaaatagtctttttttttttttttttttttttttttttgagatggagtctcactctgttgcccaggctggagtgcagtggtgcgatctctgctcactacaagctctgcctcccgagttcaagtgattctcctggctcaccctcctgagtagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctgaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaatag

SEQ ID NO: 716 - DNA, 4437 bp, Homo sapiens
cctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgaacccaggaggcgaagattgcagtgagctgatatcgcaccattgtactccagcctgtgtgacagagcaatactcttgtctcaaaaaaaaaaaaaaattcaaatcagagtgaagtgaatgagacactccagttttccttctactccgaatttcaactgattttagctcctcctttcaacattcaacaaatagtctttttttttttttttttttttttttttttgagatggagtctcactctgttgcccaggctggagtgcagtggtgcgatctctgctcactacaagctctgcctcccgagttcaagtgattctcctggctcaccctcctgagtagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctgaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaatag

SEQ ID NO: 717 - DNA, 41 bp, Homo sapiens
ttctattttatttagagcttaacttagatagcagtaatttc

SEQ ID NO: 718 - DNA, 48 bp, Homo sapiens
aatttccctggagtaaaactgcggtcaaaaatgtccctccgttcttat

SEQ ID NO: 719 - DNA, 32 bp, Homo sapiens
ttcttatggaagccgggaaggatctgtatcaa

SEQ ID NO: 720 - DNA, 48 bp, Homo sapiens
caagccgttctggagagtgcagtcctgttcctatgggttcatttccaa

SEQ ID NO: 721 - DNA, 42 bp, Homo sapiens
tttccaagaagagggtttgtaaatggaagcagagaaagtact

SEQ ID NO: 722 - DNA, 45 bp, Homo sapiens
tactggatatttagaagaacttgagaaagagaggtaacttttctt

SEQ ID NO: 723 - DNA, 229 bp, Homo sapiens
ttctattttatttagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtaacttttctt

SEQ ID NO: 724 - DNA, 20 bp, Homo sapiens
ttttatttagagcttaactt

SEQ ID NO: 725 - DNA, 34 bp, Homo sapiens
gtttctattttatttagagcttaacttagatagc

What is claimed is:

1. A method of administering a treatment regimen to a patient, wherein said administering treatment regimen comprises performing a bilateral mastectomy on the patient, the method comprises the steps of:
    a) extracting genomic DNA from a sample comprising germline cells of the patient;
    b) forming a mixture by hybridizing nucleic acid probes in a library to a plurality of nucleic acid molecules in the genomic DNA, wherein said plurality of nucleic acid molecules comprise the coding regions of a plurality of test genes and wherein said plurality of test genes comprise target genes: APC gene, ATM gene, BARD1 gene, BMPR1A gene, Breast Cancer 1 (BRCA1) gene, Breast Cancer 2 (BRCA2) gene, BRIP1 gene, CDH1 gene, CDK4 gene, CDKN2A gene, CHEK2 gene, EPCAM gene, MLH1 gene, MSH2 gene, MSH6 gene, MUTYH gene, NBN1 gene, PALB2 gene, PMS2 gene, phosphatase and tensin homolog (PTEN) gene, RAD51C gene, RAD51D gene, SMAD4 gene, STK11 gene, and TP53 gene;
    c) performing one or more amplification reactions for amplifying said plurality of nucleic acid molecules in the mixture in the presence of one or more primer pairs, wherein each of the primer pairs generates amplification products comprising a portion of each of the target genes, the amplification products being between 50 and 1000 nucleotides in length;
    d) determining the sequences of said amplification products;
    e) comparing the sequences of the amplification products with one or more reference sequences of each of the target genes using an alignment software; and
    f) detecting whether a deleterious germline mutation is present in at least one of the sequences of the amplification products by correlating the sequences of the amplification products with deleterious germline mutations of the target genes; and
    g) administering the treatment regimen to the patient if a deleterious germline mutation in at least one of BRCA1 gene, BRCA2 gene, PTEN gene and TP53 gene is detected in the sequences of the amplification products.

2. The method of claim 1, wherein the one or more reference sequences comprise the sequence of each of the target genes in the following table:

| Entrez Gene Symbol | SEQ ID NO |
|---|---|
| APC | 1 |
| ATM | 20 |
| BARD1 | 21 |
| BMPR1A | 60 |
| BRCA1 | 97 |
| BRCA2 | 128 |
| BRIP1 | 158 |
| CDH1 | 182 |
| CDK1 | 201 |
| CDKN2A | 212 |
| CHEK2 | 223 |
| EPCAM | 244 |

-continued

| Entrez Gene Symbol | SEQ ID NO |
|---|---|
| MLH1 | 289 |
| MSH2 | 355 |
| MSH6 | 374 |
| MUTYH | 387 |
| NBN | 411 |
| PALB2 | 430 |
| PMS2 | 450 |
| PTEN | 475 |
| RAD51C | 516 |
| RAD51D | 521 |
| SMAD4 | 546 |
| STK1 | 561 |
| TP53 | 576. |

3. The method of claim 1, wherein at least one of the amplification products comprises at least a portion of an exon sequence and an intron sequence comprising at least 10 base pairs in length flanking at least one end of said exon sequence.

4. The method of claim 1 further comprising the step of determining if the patient has at least one second level risk factor comprising personal risk factors and family risk factors.

5. The method of claim 4, wherein the personal risk factors comprise that the patient has a history of multiple primary cancers, a positive triple negative breast cancer, a history of ovarian cancer, a history of smoking, a positive tissue biopsy for a cancer, a positive vaginal pap smear for a cancer, a history of male breast cancer, an enlarged prostate, and colon polyps, and age of the patient when a cancer is diagnosed, age of menopause of the patient, and age of menarche of the patient.

6. The method of claim 4, wherein the family risk factors comprise that the patient has Ashkenazi Jewish ancestry, a relative with early onset cancer, a relative with multiple primary cancers, a relative with male breast cancer, a relative with ovarian cancer, and a relative with triple negative breast cancer.

7. The method of claim 1, wherein the target genes comprise at least 25% of the plurality of test genes.

8. The method of claim 1, wherein the target genes comprise at least 50% of the plurality of test genes.

* * * * *